United States Patent 7,745,391 (HUMAN THROMBOSPONDIN POLYPEPTIDE) - sequence listing, part 255

SEQ ID NO: 730999 - DNA, 2548 bp, Homo sapiens
  misc_feature (4)..(4): n is a, c, g, or t
gtanggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagttacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaagtgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattataaaattttctaaaatgtattttagacttcctgtagggggcgatatactaaatgtatatagtacatttatactaaatgtattcctgtagggggcgatatactaaatgtattttagacttcctgtagggggcgataaaataaaatgctaaacaactgggtatacatgcataaaaactatccattcaaacccaaaaatttaa

SEQ ID NO: 731000 - DNA, 231 bp, Homo sapiens
  misc_feature (13)..(13): n is a, c, g, or t
tctagaggatccnccgctacgctcagccaagcacccttaggataccaggaccctgtttcccttcggccctccagccccaaacctgcccagccagccctgaaaatgcaagtcttgtacgagtttgaagctaggaacccacgggaactgactgtggtccagggagagaagctggaggttctggaccacacaacgcgctgctggtctgagcgtgactggggatacctctagagt

SEQ ID NO: 731001 - DNA, 244 bp, Homo sapiens
gtggaccttcacgcttcagcaagcaccttaggataccaggaccctgtttcccttcggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcagcgtgatgctgagcta

SEQ ID NO: 731002 - DNA, 494 bp, Homo sapiens
cactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggaggtgagtacctctgcagcccccgggcagtgtccaactaaacccaagtgttcccatgtgcccaccgccctgccagaacatggacacttcacacaagtccctgccccagaagccaacagcctgtcccaaccatgtcgcatggactcagatccaacaagcctgccagagcatctgctcagtgtcagggacggggaggggtggtcagattgaacagagcaggcctggctggaggttgagcgggtgagtgtcctgtccccagacaggaagaagtagc

SEQ ID NO: 731003 - DNA, 2139 bp, Homo sapiens
cactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagtacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcggatgactggcaacttccagagccctccagccaagcacccttaggataccaggaccctgtttcccttcggccctccagccccaaacctgcccagccagccctgaaaatgcaagtcttgtacgagtttgaagctaggaacccacgggaactgactgtggtccagggagagaagctggaggttctggaccacagcaagcgtgtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaac

SEQ ID NO: 731004 - DNA, 929 bp, Homo sapiens
  misc_feature (13)..(13): n is a, c, g, or t
tctagaggatccnccgctacgctcagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcgtgtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaac

SEQ ID NO: 731005 - DNA, 877 bp, Homo sapiens
gtggaccttcacgcttcagcaagcaccttaggataccaggaccctgtttcccttcggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcgtgtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaac

SEQ ID NO: 731006 - DNA, 2229 bp, Homo sapiens
cactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagtacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcggatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcgtgtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaac

SEQ ID NO: 731007 - DNA, 1394 bp, Homo sapiens
gcacccttaggataccaggaccctgtttcccttcggtatgctctgagcttaatagggactgcgtggtcctggggagggagggacaggactgtagtcctttggatctctggctctctacatcttaagagagccaagagggtctcttttagccgagaaaaacatgtacaaggacatccctctcctaccttgggtgaaaaacagtgttctaccctcctaggctcccattgcttcttctcatgatactacccacacatgcttctgatttcccatactcaagtataaagtgcttagggcagaactcagatgtagaaaattccactcccggaaatgtcttcagaaatcaatgacatttcagacccctcctgcctgcagaaagccccacctaacactgacctgccagcaaactctaaagaaacccaaaagtcaccatcagactgcaggccggagatacctgaggggaatctcagggctgggacataggcttaatttctgaggccccattctccagccatcctgactctgtttcttaggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcgtgtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaac

SEQ ID NO: 731008 - DNA, 1696 bp, Homo sapiens
gcacccttaggataccaggaccctgtttcccttcggtatgctctgagcttaatagggactgcgtggtcctggggagggagggacaggactgtagtcctttggatctctggctctctacatcttaagagagccaagagggtctcttttagccgagaaaaacatgtacaaggacatccctctcctaccttgggtgaaaaacagtgttctaccctcctaggctcccattgcttcttctcatgatactacccacacatgcttctgatttcccatactcaagtataaagtgcttagggcagaactcagatgtagaaaattccactcccggaaatgtcttcagaaatcaatgacatttcagacccctcctgcctgcagaaagccccacctaacactgacctgccagcaaactctaaagaaacccaaaagtcaccatcagactgcaggccggagatacctgaggggaatctcagggctgggacataggcttaatttctgaggccccattctccagccatcctgactctgtttcttaggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcgtgtggctggtgaagaatgaggcgggacggagcggctacattccaagcaacatcctggagcccctacagccggggacccctgggacccagggccagtcaccctctcgggtactacccagcctggactatccagagccctaagtcttgagttggaggtcggggtggggaggattcagtggcaagcagaggagatagtcttggtttgattcggaccgtattattgcatgcttagtgtgccaactttatcatggggccagagcagagaacaagaccagctccctgccagaccagaaagccacagagtaagagaagtgatttgatgggaacctggagaagggacccagatgttaggggctgtggttggctgtgagatgagatggactctgatccctggttccccctgattctaggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaac

SEQ ID NO: 731009 - DNA, 1231 bp, Homo sapiens
  misc_feature (13)..(13): n is a, c, g, or t
tctagaggatccnccgctacgctcagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcgtgtggctggtgaagaatgaggcgggacggagcggctacattccaagcaacatcctggagcccctacagccggggacccctgggacccagggccagtcaccctctcgggtactacccagcctggactatccagagccctaagtcttgagttggaggtcggggtggggaggattcagtggcaagcagaggagatagtcttggtttgattcggaccgtattattgcatgcttagtgtgccaactttatcatggggccagagcagagaacaagaccagctccctgccagaccagaaagccacagagtaagagaagtgatttgatgggaacctggagaagggacccagatgttaggggctgtggttggctgtgagatgagatggactctgatccctggttccccctgattctaggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaac

SEQ ID NO: 731010 - DNA, 1179 bp, Homo sapiens
gtggaccttcacgcttcagcaagcaccttaggataccaggaccctgtttcccttcggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcgtgtggctggtgaagaatgaggcgggacggagcggctacattccaagcaacatcctggagcccctacagccggggacccctgggacccagggccagtcaccctctcgggtactacccagcctggactatccagagccctaagtcttgagttggaggtcggggtggggaggattcagtggcaagcagaggagatagtcttggtttgattcggaccgtattattgcatgcttagtgtgccaactttatcatggggccagagcagagaacaagaccagctccctgccagaccagaaagccacagagtaagagaagtgatttgatgggaacctggagaagggacccagatgttaggggctgtggttggctgtgagatgagatggactctgatccctggttccccctgattctaggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaac

SEQ ID NO: 731011 - DNA, 1141 bp, Homo sapiens
  misc_feature (13)..(13): n is a, c, g, or t
tctagaggatccnccgctacgctcagccaagcacccttaggataccaggaccctgtttcccttcggccctccagccccaaacctgcccagccagccctgaaaatgcaagtcttgtacgagtttgaagctaggaacccacgggaactgactgtggtccagggagagaagctggaggttctggaccacagcaagcgtgtggctggtgaagaatgaggcgggacggagcggctacattccaagcaacatcctggagcccctacagccggggacccctgggacccagggccagtcaccctctcgggtactacccagcctggactatccagagccctaagtcttgagttggaggtcggggtggggaggattcagtggcaagcagaggagatagtcttggtttgattcggaccgtattattgcatgcttagtgtgccaactttatcatggggccagagcagagaacaagaccagctccctgccagaccagaaagccacagagtaagagaagtgatttgatgggaacctggagaagggacccagatgttaggggctgtggttggctgtgagatgagatggactctgatccctggttccccctgattctaggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaac

SEQ ID NO: 731012 - DNA, 2531 bp, Homo sapiens
cactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagtacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcggatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcgtgtggctggtgaagaatgaggcgggacggagcggctacattccaagcaacatcctggagcccctacagccggggacccctgggacccagggccagtcaccctctcgggtactacccagcctggactatccagagccctaagtcttgagttggaggtcggggtggggaggattcagtggcaagcagaggagatagtcttggtttgattcggaccgtattattgcatgcttagtgtgccaactttatcatggggccagagcagagaacaagaccagctccctgccagaccagaaagccacagagtaagagaagtgatttgatgggaacctggagaagggacccagatgttaggggctgtggttggctgtgagatgagatggactctgatccctggttccccctgattctaggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaac

SEQ ID NO: 731013 - DNA, 823 bp, Homo sapiens
gcagccaagggtggatggtccagggatggagctgccaaggtgggtggcctagagagggagaaggagggtaggaaagagctggagggagaaagccttgtgtggggagggaaggctggctggaaagaggctcaggggactgaggtggtgactcttggcaggttctggaccacagcaagcgtgtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaac

SEQ ID NO: 731014 - DNA, 391 bp, Homo sapiens
ccctcctgcagcccctcagactcagacttggaggccctatccctggccccagtgcttcgacaccgtccctcacattggccctggaaagttgctttatctgaagcctggaacctcctacctcaagggggccgaggacacgtcttcttcctcttctgcttttctctacccagcacgcctgtggtccacctctctgagctttctcccagtcctaggactccccctctccctgcagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaag

SEQ ID NO: 731015 - DNA, 839 bp, Homo sapiens
  misc_feature (13)..(13): n is a, c, g, or t
tctagaggatccnccgctacgctcagccaagcacccttaggataccaggaccctgtttcccttcggccctccagccccaaacctgcccagccagccctgaaaatgcaagtcttgtacgagtttgaagctaggaacccacgggaactgactgtggtccagggagagaagctggaggttctggaccacagcaagcgtgtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaac

SEQ ID NO: 731016 - DNA, 369 bp, Homo sapiens
tccctcacctgccatcagcctcatctgaatctttgtctttcctcagataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgt

SEQ ID NO: 731017 - DNA, 518 bp, Homo sapiens
tgacactttgtatggcaagtggaaccactggcttggtggattttgctagatttttctgatttttaaactcctgaaaaatatcccagataactgtcatgaagctggtaactatcttcctgctggtgaccatcagcctttgtagttactctgctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtgacatcaagataaagagcggaggtggatggggatggaagatgatgctcctatcctccctgcctgaaacctgttctaccaattatagatcaaatgccctaaaatgtagtgacccgtgaaaaggacaaataaagcaatgaataca

SEQ ID NO: 731018 - DNA, 567 bp, Homo sapiens
aatgggggaattgtaaggagattttataggttttaaaaggccatcctctagcagtgtgagagttacccgaagctccgcgtccgtgatggtctagggggcttccgaggtgatcgggcagtgtcggtcttcagccgctaagccgagaaggagtcagagagacttaggccagagttccgggggctctgcgagtggctgccagctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtgacatcaagataaagagcggaggtggatggggatggaagatgatgctcctatcctccctgcctgaaacctgttctaccaattatagatcaaatgccctaaaatgtagtgacccgtgaaaaggacaaataaagcaatgaataca

SEQ ID NO: 731019 - DNA, 1259 bp, Homo sapiens
tataccgtgaggagtggggcggctgtgtagacacctgatctgccggtgccttggtcttggacttccagcctccagaactgtccatgtcacaaacggcgggcaagcatctgctgtacccagctggggtccctgtcggccctgaagcatgctgtcctggggctctacctgctggtcttcctgattcttgtgggcatcttcatcttagcagtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggctcaaccacagcctgtcctacgacgtggcctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtggcgtggaggccccgatgatgatccgcctggtgaatggctcaggtccgcacgagggccgcgtggaagtgtaccacgaccggcgttggggcaccgtgtgtgacgacggctgggacaagaaggacggagacgtggtgtgcc

SEQ ID NO: 731020 - DNA, 1676 bp, Homo sapiens
gtagaggagctgccggtgcctcctcagaacatctcctgatcgctacccaggaccaggcaccaaggacagggagtcccaggcgcacaccccccattctgggtcccccaggcccagacccccactctgccacaggttgcatcttgacctggtcctcctgcagaagtggcccctgtggtcctgctctgagactcgtccctgggcgcccctgcagcccctttctatgactccatctggatttggctggctgtggggacgcggtccgaggggcggcctggctctcagcgtggtggcagccagctctctggccaccatggcaaatgctgagatctgaggggacaaggctctacagcctcagccaggggcactcagctgttgcagggtgtgatggagaacaaagctatgtacctacacaccgtcagcgactgtgacaccagctccatctgtgaggattcctttgatggcaggagcctgtccaagctgaacctgtgtgaggatggtccatgtcacaaacggcgggcaagcatctgctgtacccagctggggtccctgtcggccctgaagcatgctgtcctggggctctacctgctggtcttcctgattcttgtgggcatcttcatcttagcagtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggctcaaccacagcctgtcctacgacgtggcctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtggcgtggaggccccgatgatgatccgcctggtgaatggctcaggtccgcacgagggccgcgtggaagtgtaccacgaccggcgttggggcaccgtgtgtgacgacggctgggacaagaaggacggagacgtggtgtgcc

SEQ ID NO: 731021 - DNA, 829 bp, Homo sapiens
tataccgtgaggagtggggcggctgtgtagacacctgatctgccggtgccttggtcttggacttccagcctccagaactgtccatgtcacaaacggcgggcaagcatctgctgtacccagctggggtccctgtcggccctgaagcatgctgtcctggggctctacctgctggtcttcctgattcttgtgggcatcttcatcttagcagtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagccgggcccaagggcgatgatgggaagctgggggccacaggaccaatgggcatgcgtgggttcaaaggtgaccgaggcccaaaaggagagaaaggagagaaaggagacagagctggggatgcca

SEQ ID NO: 731022 - DNA, 1246 bp, Homo sapiens
gtagaggagctgccggtgcctcctcagaacatctcctgatcgctacccaggaccaggcaccaaggacagggagtcccaggcgcacaccccccattctgggtcccccaggcccagacccccactctgccacaggttgcatcttgacctggtcctcctgcagaagtggcccctgtggtcctgctctgagactcgtccctgggcgcccctgcagcccctttctatgactccatctggatttggctggctgtggggacgcggtccgaggggcggcctggctctcagcgtggtggcagccagctctctggccaccatggcaaatgctgagatctgaggggacaaggctctacagcctcagccaggggcactcagctgttgcagggtgtgatggagaacaaagctatgtacctacacaccgtcagcgactgtgacaccagctccatctgtgaggattcctttgatggcaggagcctgtccaagctgaacctgtgtgaggatggtccatgtcacaaacggcgggcaagcatctgctgtacccagctggggtccctgtcggccctgaagcatgctgtcctggggctctacctgctggtcttcctgattcttgtgggcatcttcatcttagcagtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagccgggcccaagggcgatgatgggaagctgggggccacaggaccaatgggcatgcgtgggttcaaaggtgaccgaggcccaaaaggagagaaaggagagaaaggagacagagctggggatgcca

SEQ ID NO: 731023 - DNA, 507 bp, Homo sapiens; identical to SEQ ID NO: 339328

SEQ ID NO: 731024 - DNA, 1410 bp, Homo sapiens
  misc_feature (1407)..(1408): n is a, c, g, or t
cggaattagggagatagttggtattaggattaggattgttgtgaagtatagtacggatgctacttgtgcaatgatggtaaaagggtagcttactggttgtcctccgattcaggttagaatgaggaggtctgcggcttggagctcctggggcctaacaaaaagaaacctgccatgctgctcttcctcctctctgcactggtcctgctcacacagcccctgggctacctggaagcagaaatgaagacctactcccacagaacaatgcccagtgcttgcaccctggtcatgtgtagctcagtggagagtggcctgcctggtcgcgatggacgggatgggagagagggccctcggggcgagaagggggacccaggtttgccaggagctgcagggcaagcagggatgcctggacaagctggcccagttgggcccaaaggggacaatggctctgttggagaacctggaccaaagggagacactgggccaagtggacctccaggacctcccggtgtgcctggtccagctggaagagaaggtcccctggggaagcaggggaacataggacctcagggcaagccaggcccaaaaggagaagctgggcccaaaggagaagtaggtgccccaggcatgcagggctcggcaggggcaagaggcctcgcaggccctaagggagagcgaggtgtccctggtgagcgtggagtccctggaaacacaggggcagcagggtctgctggagccatgggtccccagggaagtccaggtgccaggggacccccgggattgaagggggacaaaggcattcctggagacaaaggagcaaagggagaaagtgggcttccagatgttgcttctctgaggcagcaggttgaggccttacagggacaagtacagcacctccaggctgctttctctcagtataagaaagttgagctcttcccaaatggccaaagtgtcggggagaagattttcaagacagcaggctttgtaaaaccatttacggaggcacagctgctgtgcacacaggctggtggacagttggcctctccacgctctgccgctgagaatgccgccttgcaacagctggtcgtagctaagaacgaggctgctttcctgagcatgactgattccaagacagagggcaagttcacctaccccacaggagagtccctggtctattccaactgggccccaggggagcccaacgatgatggcgggtcagaggactgtgtggagatcttcaccaatggcaagtggaatgacagggcttgtggagaaaagcgtcttgtggtctgcgagttctgagccaactggggtgggtggggcagtgcttggcccaggagtttggccagaagtcaaggcttagaccctcatgctgccaatatcctaataaaaaggtgaccatcaaaaaannaa

SEQ ID NO: 731025 - DNA, 1284 bp, Homo sapiens
  misc_feature (1281)..(1282): n is a, c, g, or t
acagacatgtttctcagcacctccaaacatgggcggcaagaggccatgctgctcttcctcctctctgcactggtcctgctcacacagcccctgggctacctggaagcagaaatgaagacctactcccacagaacaatgcccagtgcttgcaccctggtcatgtgtagctcagtggagagtggcctgcctggtcgcgatggacgggatgggagagagggccctcggggcgagaagggggacccaggtttgccaggagctgcagggcaagcagggatgcctggacaagctggcccagttgggcccaaaggggacaatggctctgttggagaacctggaccaaagggagacactgggccaagtggacctccaggacctcccggtgtgcctggtccagctggaagagaaggtcccctggggaagcaggggaacataggacctcagggcaagccaggcccaaaaggagaagctgggcccaaaggagaagtaggtgccccaggcatgcagggctcggcaggggcaagaggcctcgcaggccctaagggagagcgaggtgtccctggtgagcgtggagtccctggaaacacaggggcagcagggtctgctggagccatgggtccccagggaagtccaggtgccaggggacccccgggattgaagggggacaaaggcattcctggagacaaaggagcaaagggagaaagtgggcttccagatgttgcttctctgaggcagcaggttgaggccttacagggacaagtacagcacctccaggctgctttctctcagtataagaaagttgagctcttcccaaatggccaaagtgtcggggagaagattttcaagacagcaggctttgtaaaaccatttacggaggcacagctgctgtgcacacaggctggtggacagttggcctctccacgctctgccgctgagaatgccgccttgcaacagctggtcgtagctaagaacgaggctgctttcctgagcatgactgattccaagacagagggcaagttcacctaccccacaggagagtccctggtctattccaactgggccccaggggagcccaacgatgatggcgggtcagaggactgtgtggagatcttcaccaatggcaagtggaatgacagggcttgtggagaaaagcgtcttgtggtctgcgagttctgagccaactggggtgggtggggcagtgcttggcccaggagtttggccagaagtcaaggcttagaccctcatgctgccaatatcctaataaaaaggtgaccatcaaaaaannaa

SEQ ID NO: 731026 - DNA, 534 bp, Homo sapiens
  misc_feature (470)..(470): n is a, c, g, or t
  misc_feature (506)..(506): n is a, c, g, or t
  misc_feature (514)..(514): n is a, c, g, or t
aattcgcggccgcgtcgacacggctgcgagaagagacagaaggggacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaagtcaaggcacatggcaagagggtgctgacttccttgggagatgccataaagcacctggatgatctcaagggcacctttgcccagctgagtgaactgcactgtgacaagctgcatgtggatcctgagacctcaagctcctggaaatgtgctggtgaccgtttggcaatccatttcggcaaagattcaccctnaggttcaggcttcctgcagagatggttactggagtngccagtgncctgtcctccagataccact

SEQ ID NO: 731027 - DNA, 374 bp, Homo sapiens; identical to SEQ ID NO: 506197
  misc_feature (186)..(186): n is a, c, g, or t
  misc_feature (198)..(198): n is a, c, g, or t
  misc_feature (206)..(206): n is a, c, g, or t
  misc_feature (212)..(213): n is a, c, g, or t
  misc_feature (217)..(217): n is a, c, g, or t

SEQ ID NO: 731028 - DNA, 2341 bp, Homo sapiens; identical to SEQ ID NO: 84780

SEQ ID NO: 731029 - DNA, 1989 bp, Homo sapiens
attcgggcctaggctcatctccacagaggagaacacgcagggagcagagaccatggggcccctctcagcccctccctgcacacagcatataacctggaaagggctcctgctcacagcatcacttttaaacttctggaacccgcccaccacagcccaagtcacgattgaagcccagccaccaaaagtttctgaggggaaggatgttcttctacttgtccacaatttgccccagaatcttactggctacatctggtacaaaggacaaatcagggacctctaccattatgttacatcatatgtagtagacggtcaaataattaaatatgggcctgcatacagtggacgagaaacagtatattccaatgcatccctgctgatccagaatgtcacccaggaagacacaggatcctacactttacacatcataaagcgaggtgatgggactggaggagtaactggacgtttcaccttcaccttatacctggagactcccaaaccctccatctccagcagcaatttcaaccccagggaggccacggaggctgtgatcttaacctgtgatcctgagactccagatgcaagctacctgtggtggatgaatggtcagagcctccctatgactcacagcttgcagctgtctgaaaccaacaggaccctctacctatttggtgtcacaaactatactgcaggaccctatgaatgtgaaatacggaacccagtgagtgccagccgcagtgacccagtcaccctgaatctcctcccgaagctgcccaagccctacatcaccatcaataacttaaaccccagggagaataaggatgtctcaaccttcacctgtgaacctaagagtgagaactacacctacatttggtggctaaatggtcagagcctcccggtcagtcccagggtaaagcgacgcattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccattcaggacaaaacctctacttgtcctgctttgcggactctaacccaccggcacagtattcttggacaattaatgggaagtttcagctatcaggacaaaagctttctatcccccagattactacaaagcatagcgggctctatgcttgctctgttcgtaactcagccactggcaaggaaagctccaaatccgtgacagtcagagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagtttttcccaagatgtcagaataagactccccatcatgatgaggctctcacccctcttagctgtccttgcttgtgcctgcctctttcacttggcaggataatgcagtcattagaatttcacatgtagtataggagcttctgagggtaacaacagagtgtcagatatgtcatctcaacctcagacttttacataacatctcaggaggaaatgtggctctctccatcttgcatacagggctcccaatagaaatgaacacagagatattgcctgtgtgtttgcagagaagatggtttctataaagagtaggaaagctgaaattatagtagagtcccctttaaatgcacattgtgtggatggctctcaccatttcctaagagatacattgtaaaacgtgacagtaagactgattctagcagaataaaacatgtactacatttgctaaa

SEQ ID NO: 731030 - DNA, 811 bp, Homo sapiens
  misc_feature (775)..(775): n is a, c, g, or t
  misc_feature (796)..(796): n is a, c, g, or t
  misc_feature (799)..(799): n is a, c, g, or t
acatgcagagaaacaggtgaggagaagcagcgagagagaaggggccaggtataaaaagggcccacaagagaccagctcaaggatcccaaggcccaactccccgaaccactcagggtcctgtggacagctcacctagcggcaatggctgcaggctcccggacgtccctgctcctggcttttggcctgctctgcctgtcctggcttcaagagggcagtgccttcccaaccattcccttatccaggctttttgacaacgctatgctccgcgcccgtcgcctgtaccagctggcatatgacacctatcaggagtttgaagaagcctatatcctgaaggagcagaagtattcattcctgcagaacccccagacctccctctgcttctcagagtctattccaacaccttccaacagggtgaaaacgcagcagaaatctaacctagagctgctccgcatctccctgctgctcatccagtcatggctggagcccgtgcagctcctcaggagcgtcttcgccaacagcctggtgtatggcgcctcggacagcaacgtctatcgccacctgaaggacctagaggaaggcatccaaacgctgatgtgggtgagggtggcaccaagggatccccaatcctggggccccactggcttccagggactggggagagaaacactgctgccctctttttagcaatcaggcgctgacccaagagaactcaccgtattcttcatttccctcgtgaatcctccaagcctttctctacaacctggaaggggaaggnaggaaaatgggttgaattganaanaagggaagggaa

SEQ ID NO: 731031 - DNA, 879 bp, Homo sapiens
gcagggagagagaactggccagggtataaaaagggcccacaagagaccggctcgaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttca

SEQ ID NO: 731032 - DNA, 1132 bp, Homo sapiens
gcagggagagagaactggccagggtataaaaagggcccacaagagaccggctcgaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcaccaatcctggaaccccactggcttcgagggctgggggagagaaatactgctgccctctttttagcagtaaggcgctgacccaagagaactcaccttattcttcatttcgcctggtgaatcctccaggcctttctctacaccctgaaggggagggaggaaaatggataaatgagagagggagggaacagtgcccaagcgcttggcctctccttctcttccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttca

SEQ ID NO: 731033 - DNA, 1024 bp, Homo sapiens
gcagggagagagaactggccagggtataaaaagggcccacaagagaccggctcgaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccactgcctcgtcgaggcagtggtgggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctca

SEQ ID NO: 731034 - DNA, 708 bp, Homo sapiens
cttcaagaggctggtgccgtccaaaccgttccgttatccaggctttttgaccacgctatgctccaagcccatcgcgcgcaccagctggccattgacacctaccaggagtttatcgatgccacctggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctca

SEQ ID NO: 731035 - DNA, 763 bp, Homo sapiens
cttcaagaggctggtgccgtccaaaccgttccgttatccaggctttttgaccacgctatgctccaagcccatcgcgcgcaccagctggccattgacacctaccaggagtttatcgatgccacctggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccactgcctcgtcgaggcagtggtgggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctca

SEQ ID NO: 731036 - DNA, 969 bp, Homo sapiens
gcagggagagagaactggccagggtataaaaagggcccacaagagaccggctcgaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctca

SEQ ID NO: 731037 - DNA, 1222 bp, Homo sapiens
gcagggagagagaactggccagggtataaaaagggcccacaagagaccggctcgaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcaccaatcctggaaccccactggcttcgagggctgggggagagaaatactgctgccctctttttagcagtaaggcgctgacccaagagaactcaccttattcttcatttcgcctggtgaatcctccaggcctttctctacaccctgaaggggagggaggaaaatggataaatgagagagggagggaacagtgcccaagcgcttggcctctccttctcttccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctca

SEQ ID NO: 731038 - DNA, 903 bp, Homo sapiens
gaagaaacctatatcccaaaggaccagaagtattcattcctgcatgactcccagacctccttctgcttctcagactctattccgacaccctccaacatggaggaaacgcaacagaaatccgtgagtggatgccgtctcccctaggcggggatgggggagacctgtggtcagggctcccgggcagcacagccactgccggtccttcccctgcagaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcaccaatcctggaaccccactggcttcgagggctgggggagagaaatactgctgccctctttttagcagtaaggcgctgacccaagagaactcaccttattcttcatttcgcctggtgaatcctccaggcctttctctacaccctgaaggggagggaggaaaatggataaatgagagagggagggaacagtgcccaagcgcttggcctctccttctcttccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccacca

SEQ ID NO: 731039 - DNA, 767 bp, Homo sapiens
aggctgccttctagtaccaaatgttataatcagataattgacctggtgtttgtggtgatctgatattatcaggaaaagcattactctgcctttttaaactcttaaattgatacaactgctggaagaagggaggacagatccaagagatctaatttgtatataatgggagttccagagtgaaatacaagagaaaagccagatttaatagaagtaaatttcctgagctgaataaagccttatatttgcaggttgaaagtgttcactaaattctaggcaggattgatgagaaaaggcatacacctaaacatactctgacagaattcctgaatctcaaagttaaagagaaaaatatataagattccagacagaaagaagttatttgcaatgggaaaagaattggactggtatcagacagtggaatcatatctatacctgttaagagaaaaggaaagtaaccaagaagtctctttccagccaagcatcattcacctgccagagtgaaagggatgcagaaaggattccaagaatctatcatctgcatatccccatctgaagaaactgaaaagaggactgtaactaaataacaaattaatgagaatagagacttcaagaaatgagaaggtaaagtagaaagggaagatgatgagtgaacaataagccttgtaatatacatgggtatgtatcttaatgtacttggatgatgatgaaatgactgaaaatgtgtactatatgtgttaaataaagactcttaagataaaaaaaactca

SEQ ID NO: 731040 - DNA, 4742 bp, Homo sapiens; identical to SEQ ID NO: 714894

SEQ ID NO: 731041 - DNA, 550 bp, Homo sapiens
taatgacacttcatcctagagcagggcagtgagccgtgaagttcctagtgggaccgtcatcaccattatcatttgatcctgtcggctgggggcggctggtctccttccaaagcagctgcacccgagagtctctgactccacctgaaagaatgacgctggcttaataggactctccattgctaccaaactcctcctgcacggtcttgggtgcacccaccagagggtactactattatggaaaaattttgcctccaatcattagggtgtcttgatggcgttaactgatctttccataaaaatagattcagtcatacacacatacacacactaacacacataagttacaccagtcctctgtcaaaaaagcttaggtgacttttcttgatgcaaagctctgattcccacaggaatataaaaacaaagaaagagggaaacatccctcgagaaaaaaaatagtattgcttagaaaagaaaccattttctcatttggaaatccataccatgtgtgaaaatcctatccaacggacagcaaacccaaatgttgtctaca

SEQ ID NO: 731042 - DNA, 406 bp, Homo sapiens; identical to SEQ ID NO: 87051

SEQ ID NO: 731043 - DNA, 477 bp, Homo sapiens
gaaaagcccagcggagccgggttgggcaggagctggcggcggctgtgcgctgggccttctgccttggatcctccgcggtcggcaccgcttccctgctcagattcgaacccagattcggctcccaaggctcccacggctccagggtgcccagtcttgcagccagctcgccgcccgagccccggatggaggaagcgctcactggccgctacctctgctgtttctggcaccagagattgagactgtgaacctgaactcccttgatctcctcccgttgggcccaggagggagccgaatccaggcccaaccgggctcactgagaaggtgcaggaagcccccaacgactcctactcgtgtgcggcccatactgggccaggacgctgcagtggccgagccgctgggtgtctgcaacggggagctcccccgccgctgggggcaataaacggaatcggtttcacacgctttccctcttgatctaag

SEQ ID NO: 731044 - DNA, 526 bp, Homo sapiens; identical to SEQ ID NO: 232183

SEQ ID NO: 731045 - DNA, 527 bp, Homo sapiens; identical to SEQ ID NO: 232184
  misc_feature (11)..(11): n is a, c, g, or t
  misc_feature (152)..(152): n is a, c, g, or t
  misc_feature (296)..(296): n is a, c, g, or t
  misc_feature (354)..(354): n is a, c, g, or t
  misc_feature (358)..(358): n is a, c, g, or t
  misc_feature (366)..(366): n is a, c, g, or t
  misc_feature (381)..(381): n is a, c, g, or t
  misc_feature (387)..(387): n is a, c, g, or t
  misc_feature (396)..(396): n is a, c, g, or t
  misc_feature (406)..(406): n is a, c, g, or t

SEQ ID NO: 731046 - DNA, 647 bp, Homo sapiens
gaaaagcccagcggagccgggttgggcaggagctggcggcggctgtgcgctgggccttctgccttggatcctccgcggtcggcaccgcttccctgctcagattcgaacccagattcggctcccaaggctcccacggctccagggtgcccagtcttgcagccagctcgccgcccgagccccggatggaggaagcgctcactggccgctacctctgctgtttctggcaccagagattgagactgtgaacctgaactcccttgatctcctcccgttgggcccaggagggagccgaatccaggcccaaccgggctcactgagaagaacctttaaaaatccgccaacgaatgctgttgcctggatgcactgcctatgaccttcagccgtgtgttcacgcgcgcccgcagccgtggagtggcggtccctcctgccgcccgcaaccccggggccgccggtctgcgcacaccgggagcaacttcgttacccacagcgcccgcgtcctgcggctcgcgcggaactgcgcgcgggaaggtggcagagcgacgctccagaacgctgcttgcgtagacgctgccgctgccttcagatcccaattcggccgcgcgcgggcggggccctggcagcaacgaaaatggcgagcctcgtagcct

SEQ ID NO: 731047 - DNA, 852 bp, Homo sapiens; identical to SEQ ID NO: 232186

SEQ ID NO: 731048 - DNA, 320 bp, Homo sapiens
atcaacttggaaacattccatttgtagtatcatcaaatatatattttgtaggacaatttatatatgatgtgatttgacctaccatattaaagcagacacagattacgtatcatgctttcaaccaaaattacagacttcctttgaaacatgctgcagatttgatagaggtatattatgtcttaggaaaatacaatgaagaaggtccaaatccctattgaggctggatgtctgatctgcactagacttaagaggatatatcatttcatctgcatgtaacacatagggctgaatgtgatgtcaaaagggtttcccgttaataa

SEQ ID NO: 731049 - DNA, 278 bp, Homo sapiens
ttgttaggtaaggctcatcaattgatttgttaaatcacatactaataggtggataattgtgaaaaattgaggaataacaatatacaattcaatgcttttttctttggcttttatgtcaaagccctgttgcatattttctaagtccagatggctcctaaactgaaagttactgtgagatttagctgccgtttgcattttctaaaaacatgaacattcatttatagtcaagtattggggattttaaacccttacaagatgaggctaaaagttatataaca

SEQ ID NO: 731050 - DNA, 489 bp, Homo sapiens
gaatcacctcctgggttcaagcgattctcctgcctcagcatcctgagtacaggcactacaggcacgtgagcaagagaagctgacagattcaaatgttcacaaacatttatgttctattttgatagatacataaactatgtttctcattcttatatactttatattagggcatgggattaaagtcaaaatagtggaaaattagtagaaataacatattttatatccaattaagtctccaaaatcccaacatgcactcttctgtatacgtttttcagtatgcttgactggaacggccaattctaagtagtcttggaagcaacatactgcagattaaataccttagtagcctatgttcttgaatgcggacataaaggagcaatgcttttcctatcttaaaaacagtttatatgaatgaaacttctgttctgtttaagatattatatgttgttgagtgtagttgtcaaagcaactagcacgattccaagtaat

SEQ ID NO: 731051 - DNA, 1533 bp, Homo sapiens; identical to SEQ ID NO: 94266

SEQ ID NO: 731052 - DNA, 206 bp, Homo sapiens; identical to SEQ ID NO: 94267

SEQ ID NO: 731053 - DNA, 849 bp, Homo sapiens
  misc_feature (711)..(712): n is a, c, g, or t
  misc_feature (718)..(718): n is a, c, g, or t
  misc_feature (720)..(720): n is a, c, g, or t
tgccccatgctgactccttgcttctttccagccggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttcttaaaaaaaaaacaacacaacaaaaatctttggggggccgcccccnnaaaacntnaaacactcttggccgcgcccccaatatataattgccttcttcccaaaaccgccccactggctgtccccaaacaccgggccgggtggaacccaggtcggccggtcacggcgtacccccgcgcggaaacta

SEQ ID NO: 731054 - DNA, 669 bp, Homo sapiens
tgccccatgctgactccttgcttctttccagccggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttcttaa

SEQ ID NO: 731055 - DNA, 296 bp, Homo sapiens
aaaggaaccaggaacccaatcgcaactccccttgtgtcacctctctccagcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttcttaa

SEQ ID NO: 731056 - DNA, 630 bp, Homo sapiens; identical to SEQ ID NO: 704226
  misc_feature (561)..(561): n is a, c, g, or t
  misc_feature (571)..(571): n is a, c, g, or t

SEQ ID NO: 731057 - DNA, 837 bp, Homo sapiens
  misc_feature (699)..(700): n is a, c, g, or t
  misc_feature (706)..(706): n is a, c, g, or t
  misc_feature (708)..(708): n is a, c, g, or t
agatcccttagacctcagggcagcctcaccctttgaaagaaagtagctggtttccagtccaacaaaaagttaaaaggatgctcatctctttctcggcatcactgatggaaaacagactgtgtgatggcctaaaggatccaatcaatgtgaagaatgaggagttggatgccatgatgaaggaagccagcggtcccatcaacttcaccgtcttcctgaccatgttcggggagaagctcaagggtgagtggagtgtcctgggtccaaggccccggctgccttttcccagacccttcagggacccatcagcttcatgtgccctctgacccccacaggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttcttaaaaaaaaaacaacacaacaaaaatctttggggggccgcccccnnaaaacntnaaacactcttggccgcgcccccaatatataattgccttcttcccaaaaccgccccactggctgtccccaaacaccgggccgggtggaacccaggtcggccggtcacggcgtacccccgcgcggaaacta

SEQ ID NO: 731058 - DNA, 657 bp, Homo sapiens
agatcccttagacctcagggcagcctcaccctttgaaagaaagtagctggtttccagtccaacaaaaagttaaaaggatgctcatctctttctcggcatcactgatggaaaacagactgtgtgatggcctaaaggatccaatcaatgtgaagaatgaggagttggatgccatgatgaaggaagccagcggtcccatcaacttcaccgtcttcctgaccatgttcggggagaagctcaagggtgagtggagtgtcctgggtccaaggccccggctgccttttcccagacccttcagggacccatcagcttcatgtgccctctgacccccacaggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttcttaa

SEQ ID NO: 731059 - DNA, 364 bp, Homo sapiens
atcttcttggtcattcaggttctacttaaaacaggtacaactgatttgaataagaaaaaattgaaggtgtgggcatgtctaacatcctaattgcattttgctttttctatccctggtttgaattctttgttataatacatttttatgcattatctggggaaatgatagggaactagtgaaaaagaagactatggaaaatatagctatcaaaaacttggctgggactgcaggcgcccgccaccatgcccagctagtttttttgtatttttggtggagacggggtttcgccgtgttggccaggatcacttgaggccaggagttcaggaccagactgagcaacatagttgagacctcatctctattt

SEQ ID NO: 731060 - DNA, 483 bp, Homo sapiens; identical to SEQ ID NO: 102533

SEQ ID NO: 731061 - DNA, 455 bp, Homo sapiens
cgtctgaggcgggtgagaaatccggcctgcagagtcgcggctggccttcagatctgcgggctgcctgtgagatgccgtgttacctaaatccatttgggcactgagttcccaggagtgggggcaagaattccgatgacggggctttatccggtgccgcatccagctcagagtggttcctgagaccagccaccatgggcagcccaggatgtgctcatccttgaggctttccgaggcatcaaggagatggttggataaagaatttagcacagagcttgactgatggcaggcgcccacaacatgagacacattaataatgtgtgtggaggccaggtgtagtggttcatgcctgtcaccccagcactttgggaggcagaggtgggaagatttcttgaggccaggaattcaagaccagcctgggcaacacagcgagacctcatctctaccaaaaaaaaaaa

SEQ ID NO: 731062 - DNA, 516 bp, Homo sapiens; identical to SEQ ID NO: 728740

SEQ ID NO: 731063 - DNA, 1074 bp, Homo sapiens; identical to SEQ ID NO: 104970

SEQ ID NO: 731064 - DNA, 4904 bp, Homo sapiens
  misc_feature (278)..(278): n is a, c, g, or t
  misc_feature (280)..(280): n is a, c, g, or t
  misc_feature (285)..(286): n is a, c, g, or t
  misc_feature (289)..(289): n is a, c, g, or t
ggtcaaagaagagaaggtcctgaaaacagaggaaacaaaggaagcggaacagtgaaggcataatggctccctgcttggaatccagacaatcagagagggtaaacacaagagcacctcatctgggaattgctgacgaagaagagaaaatctggggcttgcttggtgttacctctaggacgtcaccaaccaggcatttctcaagggtttatgtcggtgtgagcctgacagtgacacacaaaagcatccctccaaaatttagcctggggaccttgaaaggnantaaanntcnggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaagtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatgttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacagtcaggcccgtcttctacaggtct

SEQ ID NO: 731065 - DNA, 2258 bp, Homo sapiens
ctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattggggtgataagtggaggtgctttgttgatcttgttttgcggaaatccagcccctaggaccaagtagattgtttgtggggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacag

SEQ ID NO: 731066 - DNA, 1128 bp, Homo sapiens
cgtctccctcgcagtcccgcccgcccctcctgccgcccctgccgcgcgcgccgcagcagcgccgccttccctgcgcagtcggtgtctccgcgtcgctgggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcaggccatttacaagatggtttcgtccgtgatgaagatgccggaggacgagtcgaccccggaaaagaggactgagaaaatcttccgccaaatggacacaaacaacgacggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttagcttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctcagtcaggcccccttacccacccaccagccccaaggcccgacccctcccccaaaggggcagtccccttcttgcaggtctcagcttgcggggtggggggagtcatgccctgcatgcagccaaatggagcatctctgttctttttaataatttcagaataaagtctcatttcagtgcagtgggctg

SEQ ID NO: 731067 - DNA, 1494 bp, Homo sapiens
cgtctccctcgcagtcccgcccgcccctcctgccgcccctgccgcgcgcgccgcagcagcgccgccttccctgcgcagtcggtgtctccgcgtcgctgggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcaggccatttacaagatggtttcgtccgtgatgaagatgccggaggacgagtcgaccccggaaaagaggactgagaaaatcttccgccaaatggacacaaacaacgacggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttagcttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctcagtcaggcccccttacccacccaccagccccaaggcccgacccctcccccaaaggggcagtccccttcttgcaggtctcagcttgcggggtggggggagtcatgcccaggggaggagactttttatctggaggggagagaaggattctaggggtgtggagttggagaaagaggcttccttgagccacccttcccaccccagcccttgctggtccctaggccaagccaccaagtgaaaccttccaggatactagcccgccagctgtgggccccagaaagccagcctgccttttagcacttggatacacacagacccacggagctctctgtgtttggcctctcacacacacacaggcccatagacagatgggcagatgcacccagagccccatgcacagtgtcctgcgtgggaaagagacacggtccccctggctgagcccctgtcctcccctctgtccccccaaccgccccccctgcatgcagccaaatggagcatctctgttctttttaataatttcagaataaagtctcatttcagtgcagtgggctg

SEQ ID NO: 731068 - DNA, 945 bp, Homo sapiens
cgtctccctcgcagtcccgcccgcccctcctgccgcccctgccgcgcgcgccgcagcagcgccgccttccctgcgcagtcggtgtctccgcgtcgctgggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcaggccatttacaagatggtttcgtccgtgatgaagatgccggaggacgagtcgaccccggaaaagaggactgagaaaatcttccgccaaatggacacaaacaacgacggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttagcttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctc

SEQ ID NO: 731069 - DNA, 877 bp, Homo sapiens
cgtctccctcgcagtcccgcccgcccctcctgccgcccctgccgcgcgcgccgcagcagcgccgccttccctgcgcagtcggtgtctccgcgtcgctgggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcagagcacagtccagctatgtctagttgatcctcatttacaccagaggaaacggatgctcagagagataaaggcacttgcttgaggccacacagcctgtgtgagtgggccatctggcaccactgtctacattccatctggatacccagccatcttctaactaattgattgagggcccactatgagcctagcattgagtgaggtgctcatgagctcagtgcgtgcttacaacaaccccatgaggctcagagaggtgaggtgatgtgcccaaaatcacacagcacataagtggagaaaagctctggctggccactacttagagctgtctactgagagggctctggactcatagccaggaggtctggcttccagttctggaagtg

SEQ ID NO: 731070 - DNA, 263 bp, Homo sapiens
gcctgatcactcctctctgcccttgacccccttggggacccaggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagc

SEQ ID NO: 731071 - DNA, 518 bp, Homo sapiens; identical to SEQ ID NO: 103989
  misc_feature (7)..(7): n is a, c, g, or t
  misc_feature (10)..(10): n is a, c, g, or t

SEQ ID NO: 731072 - DNA, 686 bp, Homo sapiens
cgaacttggggcagcccctggaagtcttgttctttgaccattacgtctgcggctgcatcaccagataatgagcttcaccacttgtctgcctcctgtgtccttccgcggggagtaaatgtcacttcagcttgccgcatctctaaataggcaaattttcagtgctcagaaaaggacctgatctttgacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagatgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctgcaagcccccccacccccctggtctcctgagctcggtaaggtgctccagctgcctctaccatagcacttcctacatggactgtaacatttctttactgctccaacttctcattaaattgggggctcctcaaagccagggttggt

SEQ ID NO: 731073 - DNA, 475 bp, Homo sapiens
  misc_feature (13)..(13): n is a, c, g, or t
  misc_feature (43)..(43): n is a, c, g, or t
  misc_feature (65)..(65): n is a, c, g, or t
  misc_feature (86)..(86): n is a, c, g, or t
aaagcaaccccanggcctaaccttaaaagtggaaattccaggnggttaaattccaccttaaatancccctagagaaatttccccangttgtataatactgttccttggcctcgggaagttccttattcatctcccacgtgtgataagactttggtgaataaatgcaccattttattccgtggatatttatttagttgtgtttcctaatttttgccaagaaatggaaacagcagcaatgaaattggtttttatttttttggatccttaagaaataggtgctttttgaagaatcaggggagaagtaacgcaagaccccagaagtatgccaacatataaaaccccaagtcaaaaggtcaaaccacgcatttgatccctcaagtcccctgcttgaccctcttccaagtgtactttccttcctttcattcctgctctaaagctttttaatactttcactcctgctcaaaagaaaaaaaaa

SEQ ID NO: 731074 - DNA, 1203 bp, Homo sapiens
cgcgccgatggtacgcgccggctcgcctggcccggctgcagtggatgttgctggaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaaccca

SEQ ID NO: 731075 - DNA, 4706 bp, Homo sapiens
cgcgccgatggtacgcgccggctcgcctggcccggctgcagtggatgttgctggaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccaggaagcccggcagagccctgagccccactgcaattcctcctagggctgcacaatcatgtggccttagggcacactgtcctgcatccagtctgtgtcctcctgtctttctcatccaggtcaggcattgacactttgtaagaaagggggtaggggacacagctgggcaggtggagtgggtgggcaggatggctgtcccagtctgcccatcttctcttggctctgggaccagcggcttgttctagggatttggacctggaggccaagggcaataggagagggtctgaagcctgtgctgtctgctgcttgctgtgaatggccctcccgggtcatgacagagctcttttggggcaggaggtgagggcagggggccccgctccttggtaagggcctgccctggggctcccagggaagtgggagctggggagccaatccacccagacccgcgtccacctgggaggcatttggggttgcaggaccgagacccacatcctctcactcacttctccacccgccaggcagctgccacaggcctaaggctgagtgaggtgtgattgggccctccggctggatgttctgggggaggaggcaatcgctgtagctgccaggccagccccatctggaaggagtccctgctctgcctcagccctaacccgaggctgtgtgggagtcccttctgcacctcttatttcctaaacccttcctgtcagctgctgtttgctggctcgtccccagccaggcctcctgaggtcttcatagttggcacagtccacatctcttctagcttcactggccactcactcagcccagagtccctaagtgctcccccacttatctctgcatctctccaatttggaagccatccagctgatgctaacagccagggccagtccctccagctggtcccatgtaatgaggccagggctccttatcagcttccaggcggctgggatctcaggcagggtgtgcgtcagccctccaacccccagaggggcgcctgtggggagggaaccaggaggccacactgggggagcgtgcagccagcatgtgcagtggccaactccaggccagtggaaagttactgtgtggatacaggaaggctctgagtggctagcaggaccctcccttggttcgccctcctcctcttctctctcccctgtgctgggagctccgtctgccttgggaagggagacgaggtgtgctgttccttcccagccccatccctccccacccttcctactcccagctttcaagaaacattgcagaagcatttgaagttttgttccatcttggatatttgaagagaaaaggagccaagaactggcgggtggtgtgtgtgcagcaaaggcattgggggcacgggtgagatgcccactgtgtgctggtctaaattaatccatcgcagtgatcctccagagacagcgctctgctcatgtccgtagcagagggaaaagccgaggtgctcagaaaggctcggtaatgagtcccaggtcatacggctagcgagtggcgggcctggggttcagacccacagctgcctcaagcaaacagggtatcacgcttgcccctgggcctgggtgggggccggaatgagaccacatgagagcgcagagaggtgggtggtcaggccctgatgtcctggggatttcttgtcctcagtgccacccggcctcccgtctttcctgaaacccctcgccagattttgcactctgaggtttctatcttccagacaagagctgggaggcaagatttctggtttctggttcctagcctcactgccagcgggctcctgctattaggtgagggtttcttgctgtctggaattcagtttttccatctgccacatggaagttcatagccaggatagggcgggagaggcaccagaacatttctctccactgactttctcacccggttcccaccctcctccacctcctctcctccgggcccctcagtttcctctcctcatctctggcctcagttccagagggttagccccagcaccccactctcctgccactgtcagatagccttggtcatgcttcctagaatctacttgtccaagttctcctctccctgggataagttactgcagaaactggggatttagaagcttattcagggctgagtgccaaaagcttgggggaggagggacaggtcctcggcaataaacagtgtcacacacgcatcacagccatttgagaaatggcttctttgcagagctggggaagccgggcagaagatgccgcagcctcctactctgggtcctgagggggggtggcaggtaccacagtgtaggcagcagggtcagggccaaagtctatgcgttccatctccaatccaggcagtgaggaatcctgaaacaccaggagaggcgtcagaagtaggaagggcaggggaacaggaatgcaagattaaggaaaccgcagctgagcaggtgtcacaagctgtaaaggaggaagggagtctgcaggcccttcacatttttggcctgggtggggctgggcccaggaaggggtgggctggattttgtaaagctggaggcagccaggaatctgactgtccggaatgtgagttgaggggtctcccactgaagtcctcttctggaagctgcagatgggggcccgggaggcacacacgagtctgggactcattcccgggcacacctatggctccttcggtatcacctggggaagccccggaatcttagttcttccattccctactcttccttccgagggagtcaggatgggacagacacccattttccaaaaggctccttgcctccttccctggcccacctgaagccaagtcccaggtgtcctggctgctctcctgggcggggtgggatttttgcataagcactttgctgccctccagtggctgcttgaggaaacgcagggcctggtttgggagagtcaccgagggcccatgtggctggaggttgggggcaggatctggcccgagctctcctcagacctccccagacctgtcttctcatcagccaccgctgttttcttttgccgaacgatggttgcatctctcggacacagtgtaccccctcccaagccctccctgagccgttctcctgagtccctgagggcagacacagctccagggacccaggccggctgccacacccccgacactcctgctgtccactggccttagctcctgcaagttccccagtgtccgcacctgttcccttccctgacctcaccttcctggggtctgtgactgactggagataaaaataaaagcaattgtgacacctgag

SEQ ID NO: 731076 - DNA, 4603 bp, Homo sapiens
cgcgccgatggtacgcgccggctcgcctggcccggctgcagtggatgttgctggaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccaggaagcccggcagagccctgagccccactgcaattcctcctagggctgcacaatcatgtggccttagggcacactgtcctgcatccagtctgtgtcctcctgtctttctcatccaggtcaggcattgacactttgtaagaaagggggtaggggacacagctgggcaggtggagtgggtgggcaggatggctgtcccagtctgcccatcttctcttggctctgggaccagcggcttgttctagggatttggacctggaggccaagggcaataggagagggtctgaagcctgtgctgtctgctgcttgctgtgaatggccctcccgggtcatgacagagctcttttggggcaggaggtgagggcagggggccccgctccttggtaagggcctgccctggggctcccagggaagtgggagctggggagccaatccacccagacccgcgtccacctgggaggcatttggggttgcaggaccgagacccacatcctctcactcacttctccacccgccaggcagctgccacaggcctaaggctgagtgaggtgtgattgggccctccggctggatgttctgggggaggaggcaatcgctgtagctgccaggccagccccatctggaaggagtccctgctctgcctcagccctaacccgaggctgtgtgggagtcccttctgcacctcttatttcctaaacccttcctgtcagctgctgtttgctggctcgtccccagccaggcctcctgaggtcttcatagttggcacagtccacatctcttctagcttcactggccactcactcagcccagagtccctaagtgctcccccacttatctctgcatctctccaatttggaagccatccagctgatgctaacagccagggccagtccctccagctggtcccatgtaatgaggccagggctccttatcagcttccaggcggctgggatctcaggcagggtgtgcgtcagccctccaacccccagaggggcgcctgtggggagggaaccaggaggccacactgggggagcgtgcagccagcatgtgcagtggccaactccaggccagtggaaagttactgtgtggatacaggaaggctctgagtggctagcaggaccctcccttggttcgccctcctcctcttctctctcccctgtgctgggagctccgtctgccttgggaagggagacgaggtgtgctgttccttcccagccccatccctccccacccttcctactcccagctttcaagaaacattgcagaagcatttgaagttttgttccatcttggatatttgaagagaaaaggagccaagaactggcgggtggtgtgtgtgcagcaaaggcattgggggcacgggtgagatgcccactgtgtgctggtctaaattaatccatcgcagtgatcctccagagacagcgctctgctcatgtccgtagcagagggaaaagccgaggtgctcagaaaggctcggtaatgagtcccaggtcatacggctagcgagtggcgggcctggggttcagacccacagctgcctcaagcaaacagggtatcacgcttgcccctgggcctgggtgggggccggaatgagaccacatgagagcgcagagaggtgggtggtcaggccctgatgtcctggggatttcttgtcctcagtgccacccggcctcccgtctttcctgaaacccctcgccagattttgcactctgaggtttctatcttccagacaagagctgggaggcaagatttctggtttctggttcctagcctcactgccagcgggctcctgctattaggtgagggtttcttgctgtctggaattcagtttttccatctgccacatggaagttcatagccaggatagggcgggagaggcaccagaacatttctctccactgactttctcacccggttcccaccctcctccacctcctctcctccgggcccctcagtttcctctcctcatctctggcctcagttccagagggttagccccagcaccccactctcctgccactgtcagatagccttggtcatgcttcctagaatctacttgtccaaataaacagtgtcacacacgcatcacagccatttgagaaatggcttctttgcagagctggggaagccgggcagaagatgccgcagcctcctactctgggtcctgagggggggtggcaggtaccacagtgtaggcagcagggtcagggccaaagtctatgcgttccatctccaatccaggcagtgaggaatcctgaaacaccaggagaggcgtcagaagtaggaagggcaggggaacaggaatgcaagattaaggaaaccgcagctgagcaggtgtcacaagctgtaaaggaggaagggagtctgcaggcccttcacatttttggcctgggtggggctgggcccaggaaggggtgggctggattttgtaaagctggaggcagccaggaatctgactgtccggaatgtgagttgaggggtctcccactgaagtcctcttctggaagctgcagatgggggcccgggaggcacacacgagtctgggactcattcccgggcacacctatggctccttcggtatcacctggggaagccccggaatcttagttcttccattccctactcttccttccgagggagtcaggatgggacagacacccattttccaaaaggctccttgcctccttccctggcccacctgaagccaagtcccaggtgtcctggctgctctcctgggcggggtgggatttttgcataagcactttgctgccctccagtggctgcttgaggaaacgcagggcctggtttgggagagtcaccgagggcccatgtggctggaggttgggggcaggatctggcccgagctctcctcagacctccccagacctgtcttctcatcagccaccgctgttttcttttgccgaacgatggttgcatctctcggacacagtgtaccccctcccaagccctccctgagccgttctcctgagtccctgagggcagacacagctccagggacccaggccggctgccacacccccgacactcctgctgtccactggccttagctcctgcaagttccccagtgtccgcacctgttcccttccctgacctcaccttcctggggtctgtgactgactggagataaaaataaaagcaattgtgacacctgag

SEQ ID NO: 731077 - DNA, 430 bp, Homo sapiens
tgattagttggtgaaaaaaataaagtgtattataggtaataaaattctgtaaataccatttttaataatcactgcaaaatgaagtaaagtttatttagcataaaagcagtaggaaataaatgttatgtttaaggaatgagaagacactcaaagtaggtagccttttgaatgaaaatgaatgaataaactaattccttaataagggaaattataaatgttctttgatttgcaagtaacttctagaaaattgtccaaccctttgttcacagtataattaaaaataagaaattataaatattctttgatttgcaagtaacttctagaaaattgtccaaccctttgttcacagtataattaaaaataagaaagtattaggttctttttctgactttcctccaaactgaaagttaaatgtctctaaaaaatagaa

SEQ ID NO: 731078 - DNA, 2476 bp, Homo sapiens
ccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcatcttgtgtcatggtttaatttttctaggtaagaaaatatgttcttgattctgtgtttacttatgtaaatgattatttgcttttctgaaaaat

SEQ ID NO: 731079 - DNA, 2679 bp, Homo sapiens
ccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagagatttaaatatctcggttgactgcagcttcaatcatgggatctgtgactggaaacaggatagagaagatgattttgactggaatcctgctgatcgagataatgagctatatcatattgggagcccataggttattccaggacctccacagctgatataaggttatgttaagtcttaagttgagtcttctgtccaagggaagttccctatttacaaacactcaattcacaaataaccccagggttctcagcttctgcatcattcaaatcatacccctgctcctcctgcacctccattggatttctagctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcatcttgtgtcatggtttaatttttctaggtaagaaaatatgttcttgattctgtgtttacttatgtaaatgattatttgcttttctgaaaaat

SEQ ID NO: 731080 - DNA, 2612 bp, Homo sapiens
ccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcacatgcccccaaagagcctggccagcaatcacactggaacacagcagtgctttcataagaggcattctcagacccaggcatctgttccttgaattcttcagttctaggggaaatcttgatggggggatattgaaggatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcatcttgtgtcatggtttaatttttctaggtaagaaaatatgttcttgattctgtgtttacttatgtaaatgattatttgcttttctgaaaaat

SEQ ID NO: 731081 - DNA, 478 bp, Homo sapiens; identical to SEQ ID NO: 728745

SEQ ID NO: 731082 - DNA, 521 bp, Homo sapiens; identical to SEQ ID NO: 728746

SEQ ID NO: 731083 - DNA, 1861 bp, Homo sapiens
  misc_feature (757)..(757): n is a, c, g, or t
gggctggacgcgacccagagcctccgccacccgcttctgccactcaatggaggacggtctgctggagatcatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacgacgtgtgcgccaaccagcgagccatcgtctccatgtgccagattatgaccactgcgccccgccaggcggctttgggcgtggtcggcggcaaggggagcttccagagcgacccccaagagccggagactccttcgcctgggatcggggacagcggcttgctgggtcgcgatcccgaggacgaggaggacgaggaagaagagaaggagatgcccagccccgccacaccctccagtcactgtgagcgccccgaaagcccctgtgctggtctccttgggggggacgggccacttgtggagcccctcgacatgcccgacattaccctgctgcaactggagggcgaggcctccctgtgaggggactccgtggggcactaccttcccgggctgtctttgggtttccgagtgcatgacgcgagggggactgaacggcgcggtgcggcatgcttcacttggacagctgctcttgtgggtcaggcaganagagactccctcgaggaaggatttgtagggtgaaggactttgggagcatcgagaattctttctgcccaactaagcgaattatagcgaactgcggaaaggtgaggctccgggagaggaagcgcccatctctggactcccatccatccctatcctgtcctttcccccttcccagacaacaggagaacccgtgaattgtgtaaataaaattctgctttttctattctgaaaaaggacttacctaggaccatggcaaataatctctaacaatttacctggaaattaaggaattgggggtattttgttctggcaacaggaaatttacccttctgctgaaatccaagatattcagtgctctgcagaagcctctccccctcacagatctctgcggctgctgattggtaaaggaagcttgaggagggaactgcagccctaggaatctgggtgaatggggttccaagggcccctgggctgggaggagctggctatgaatgtgcatgaagacataatagctcaacctctaggattttgcatgcagagcggatcctgccttgtcactgacttcatctgggattgcttttccactccctggggcttagagaacaaagagcccggttcacaggcagagactcgggggtgctcagcagcagcccagatttaggggacatttgagggactcttggggccgcagccaaaaactgtctctcctggctacacctgcttaacttcagttcctttttctgtcaatatgtccttgcccactgcctctcggtgttgccttcataatgtcttgtgtgtgttatgtgtgtctacttgtgtagtagtgtgtgagccctcaggggcagggcttgtggctctggtgttaggttcaggggcttcagacccttctacgagctccaagctatcaatggcgcttttctctccctcttcccccaaccagggcatggagcatgtggctgtcctgaggttcttttactgatgtgccgcccttccacctcctcaagtggtgactttgtgtgccctccccctcctttgtgtattccttctcaatgctttccttggtgttaaccttaataaaaaggcgtcatctccccttgaaaaaaaaaa

SEQ ID NO: 731084 - DNA, 709 bp, Homo sapiens
cggcacccgagccctgagggtcccagccccgcgctccgcgtccccgggacagcatggagcgcccggagcccgagctgatccggcagagctggcgggcagtgagccgcagcccgctggagcacggcaccgtcctgtttgccaggctgtttgccctggagcctgacctgctgcccctcttccagtacaactgccgccagttctccagcccagaggactgtctctcctcgcctgagttcctggaccacatcaggaaggtgatgctcgtgattgatgctgcagtgaccaatgtggaagacctgtcctcactggaggagtaccttgccagcctgggcaggaagcaccgggcagtgggtgtgaagctcagctccttctcgacagtgggtgagtctctgctctacatgctggagaagtgtctgggccctgccttcacaccagccacacgggctgcctggagccaactctacggggccgtagtgcaggccatgagtcgaggctgggatggcgagtaagaggcgaccccgcccggcagcccccatccatctgtgtctgtctgttggcctgtatctgttgtagcccaggctccccaagcttccctgcatcttggtccttgtccccttggccacactggagaggtgatggggcagggctgggtctcagtatcctagagtccagctgcagaaggagtggcttttcctccaggaaggggctt

SEQ ID NO: 731085 - DNA, 531 bp, Homo sapiens
aattattatataattccatttataaaagatagttagaatagccagttacatagagacagaaattagaatggtgggtgctaagggttcgagggagaaggagtgagagttactgtttattgggtacagaggtttaatatggtaagaggaaaaagttctggaaatggatagtgtgatggttacacaacactaaattgcacacttagaaatagctaatggtaagccttatattagatatatataaagtgtctggtagtcttaccctctctataattacacactttttggcactgcccttttcctgccatgcagagctccaggggtgaatctccctatttctctagctctgcatcagtcacagtcctccatgctgtgtcccacgtactgtgcccacagcttcatacaaccgctgacttcagagccaggaccaggctcaggagtctgccctgaggctccttctcttctcatttccctgcagcctggcccgggggaggcttggcttcaactggcagctccatttagcgaaattcagga

SEQ ID NO: 731086 - DNA, 967 bp, Homo sapiens; identical to SEQ ID NO: 373261

SEQ ID NO: 731087 - DNA, 537 bp, Homo sapiens
  misc_feature (50)..(50): n is a, c, g, or t
  misc_feature (54)..(54): n is a, c, g, or t
  misc_feature (273)..(273): n is a, c, g, or t
  misc_feature (293)..(293): n is a, c, g, or t
  misc_feature (295)..(295): n is a, c, g, or t
  misc_feature (299)..(299): n is a, c, g, or t
  misc_feature (315)..(315): n is a, c, g, or t
  misc_feature (323)..(323): n is a, c, g, or t
  misc_feature (353)..(353): n is a, c, g, or t
  misc_feature (451)..(451): n is a, c, g, or t
ccacacctactgcatccgctttgaccccactggatgagggcatgcctcanccantggaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatnttcgacaccataacaacagntnctcnaactgtaaaccagganaacaagtngatgacttcacactgtggacagtttttccnaagatgtcagaacagactccccattcatggattaagggctcccacccctcttaactgtccttggcttcatggcctggcctctttcacttgggcagggntaatggcagtcattaggattttcacatgtaggtaggttctgagggtaacacagggtgttcaggtttgtccttctcaacctcaaact

SEQ ID NO: 731088 - DNA, 1175 bp, Homo sapiens; identical to SEQ ID NO: 728748

SEQ ID NO: 731089 - DNA, 298 bp, Homo sapiens
ttgggccggtggagcccctggacggtccagcaggtgctgtcctggagtgcctggtgttgtctccggaatgctggtgccggaactcgctatccctgttgtctacctgctgggggcactgaccatgctgagtgaaacacgagcacaagctgctggcggaggcgctggagtcgcagaccctgttggggccgctcgagctggtgggcagcctcttggagcccagtagccatgtggccagtctaccatggggcccaggagttggggaaacacaataaaggtggcatacgaaggaaaaaaaaaa

SEQ ID NO: 731090 - DNA, 1680 bp, Homo sapiens; identical to SEQ ID NO: 728751

SEQ ID NO: 731091 - DNA, 483 bp, Homo sapiens; identical to SEQ ID NO: 129163

SEQ ID NO: 731092 - DNA, 873 bp, Homo sapiens
ggttctatctgaaggaacttgatccagcagagcactcctatgtcttgatcagaaaaatcgatcctgccctggtttggggcctgacaggcgaccagggcacaccaaagacccggctcctgatgattactctggactcgatcttcatgcaggccagctgtgtccccgaggaggtggtctgggaggtgttgagggtgttggaggcacatttcgtctaaaaagcatttcgtctttggggagtccatgaagctcatcaccaaagctagtgtgcagcaggagtatctggtgcacaaataggtgtcccacagcaatcccacgctctaggtattcttgtgggggctctcaaaggaaacaagacagatggaagtcccggagtttgtggccaaagtgaatgacacccaccccagttcctttccgtggcagtaaatgaggcattgagagaagaggaggagataccccgtgcccgagatggcagctgccgttggtgacgtgacaagtgccagtgttagtgccagttccagttccagggcctatgccatggctgaagcaagcatcagcaccagcaccaatgcaagtgccagttgccagtgccagggctagagccatggctggagcaagtatcagtacctgggacagtgccagtgtggttgcaatctcaggctagtgtcagggactcctcctgccagcagtgaaggctggggctgagtcttcactttgttttgctgtgggtagtcaaaagggccccacagcagtgggtgctggggtcctgacttttcaagagtcgaggggtagagtggggttagggagaacctgccgcccatggtatctgtgttccagttctatttgtctttctcagtgatttagctttcaatttgc

SEQ ID NO: 731093 - DNA, 711 bp, Homo sapiens
ggttctatctgaaggaacttgatccagcagagcactcctatgtcttgatcagaaaaatcgatcctgccctggtttggggcctgacaggcgaccagggcacaccaaagacccggctcctgatgattactctggactcgatcttcatgcaggccagctgtgtccccgaggaggtggtctgggaggtgttgagggtgttggaggcacatttcgtctaaaaagcatttcgtctttggggagtccatgaagctcatcaccaaagctagtgtgcagcaggagtatctggtgcacaaataggtgtcccacagcaatcccacgctctaggtattcttgtgggggctctcaaaggaaacaagacagatggaagtcccggagtttgtggccaaagtgaatgacacccaccccagttcctttccgtggcatcgataaacaccggtgtttatcgatgccactcccaaggtccggggagtggctatcggaggtagtatcaggctaggacgtgttcttcatagataagtggaggagaaatgctgtaagaattcacctgatgagtattcaaaaaacaaggtggcatcgtatagggagggacatgtggatgggtatggcaggttgttaccgtagaggtcgttctgtccattgatctagggatggtaagagtggtatggatggtgagtgtttagtaaggtaacgtcgtgactcatatagagagagatg

SEQ ID NO: 731094 - DNA, 419 bp, Homo sapiens
ggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatggtgagtttggggaaaatagagt

SEQ ID NO: 731095 - DNA, 211 bp, Homo sapiens
cccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcctgggttcaagcaattctcctgcctcagcctcccaagt

SEQ ID NO: 731096 - DNA, 3259 bp, Homo sapiens
  misc_feature (1450)..(1450): n is a, c, g, or t
cacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgngatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaacaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 731097 - DNA, 3182 bp, Homo sapiens
  misc_feature (1450)..(1450): n is a, c, g, or t
cacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgngatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaacaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 731098 - DNA, 3105 bp, Homo sapiens
  misc_feature (1450)..(1450): n is a, c, g, or t
cacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgngatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaacaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacttccaggacccctcggttcccccagggaccccctccccagtttcctgcctctgacagctgtctttaaatatgcaaactccacccatcttcccagaatccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 731099 - DNA, 3182 bp, Homo sapiens
  misc_feature (1450)..(1450): n is a, c, g, or t
cacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgngatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaacaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 731100 - DNA, 3221 bp, Homo sapiens
  misc_feature (1450)..(1450): n is a, c, g, or t
cacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgngatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 731101 - DNA, 3144 bp, Homo sapiens
  misc_feature (1450)..(1450): n is a, c, g, or t
cacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgngatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 731102 - DNA, 3067 bp, Homo sapiens
  misc_feature (1450)..(1450): n is a, c, g, or t
cacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgngatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacttccaggacccctcggttcccccagggaccccctccccagtttcctgcctctgacagctgtctttaaatatgcaaactccacccatcttcccagaatccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 731103 - DNA, 3144 bp, Homo sapiens
  misc_feature (1450)..(1450): n is a, c, g, or t
cacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgngatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 731104 - DNA, 2564 bp, Homo sapiens
  misc_feature (793)..(793): n is a, c, g, or t
cctgcgcctttcagaaccaatgagccggaacggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgngatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 731105 - DNA, 2487 bp, Homo sapiens
  misc_feature (793)..(793): n is a, c, g, or t
cctgcgcctttcagaaccaatgagccggaacggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgngatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 731106 - DNA, 2410 bp, Homo sapiens
  misc_feature (793)..(793): n is a, c, g, or t
cctgcgcctttcagaaccaatgagccggaacggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgngatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacttccaggacccctcggttcccccagggaccccctccccagtttcctgcctctgacagctgtctttaaatatgcaaactccacccatcttcccagaatccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 731107 - DNA, 2487 bp, Homo sapiens
  misc_feature (793)..(793): n is a, c, g, or t
cctgcgcctttcagaaccaatgagccggaacggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtcgcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatcctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgngatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagca

SEQ ID NO: 731108 - DNA, 732 bp, Homo sapiens
  misc_feature (475)..(475): n is a, c, g, or t
caacagttgcacgggcctcaagggtgtcacgcgacatgaaagacactcatctcaggccacacaggattccatctattgaacattcctgagacaacggaattctggcgatggagcacagcccagtaaaggcgccattccccattttacagctggggaaactgagttacagagcttgtctgcactgagtcatcaggagcaaatgctagatcagtagggtctctctctctgccacccaggccagagtgcagttgacgcagggcaggggagccccgaagtggagcatagtgtgtccggaactggtgggttcttggtctcactgacttcaagaaagaagccgcggaccctcgcgaaactcctgggagggcagagggcatgcctgccatcttcatcatggcattaccaccacccaacactatcaggggacctgccctgataatcaggtaggttcttttctattttcctaagcgtcgactgncttgagaaataaaaggacagagtacaaaagagagaaattttaaagttgggtatccgggggagacaatacacattggtaggatccgtgatgccccacaagccacaaaaaccagcaagttttcattagggagtttcaaaaggggagagagtgtatgaataggagtgggtgacagacatcaagtacttaacagggtaatagaatatcacaaggcatgttgggactgggtgagatcacagtaccacaggatggatgtgaat

SEQ ID NO: 731109 - DNA, 275 bp, Homo sapiens; identical to SEQ ID NO: 131643

SEQ ID NO: 731110 - DNA, 711 bp, Homo sapiens
  misc_feature (454)..(454): n is a, c, g, or t
cctaaccagggatgggtctgggtgattaaggaaggttggcttcagaactgggccaggggcactgctttgcttttgctgttttgatcagctctctgcctgaaggagacaagaaaaaccaacgggaacagctggggaaactgagttacagagcttgtctgcactgagtcatcaggagcaaatgctagatcagtagggtctctctctctgccacccaggccagagtgcagttgacgcagggcaggggagccccgaagtggagcatagtgtgtccggaactggtgggttcttggtctcactgacttcaagaaagaagccgcggaccctcgcgaaactcctgggagggcagagggcatgcctgccatcttcatcatggcattaccaccacccaacactatcaggggacctgccctgataatcaggtaggttcttttctattttcctaagcgtcgactgncttgagaaataaaaggacagagtacaaaagagagaaattttaaagttgggtatccgggggagacaatacacattggtaggatccgtgatgccccacaagccacaaaaaccagcaagttttcattagggagtttcaaaaggggagagagtgtatgaataggagtgggtgacagacatcaagtacttaacagggtaatagaatatcacaaggcatgttgggactgggtgagatcacagtaccacaggatggatgtgaat

SEQ ID NO: 731111 - DNA, 1358 bp, Homo sapiens
ttcttcgacatcagaggcttcatgctggagagtaaaatttggaatataatgagtatgggaagatttgtatggaagcaccttttttttctcctaaattcctaggaatgtaagactcaatctgtagctagtatgaatattttgtattttgaacaagaaatgttgtgtcctaatgtgtcctagtctggagtttgatgccttatctgctgctcagtgggtgtaaccttatcccttctgagcctcagtttccccattccccccaatagaaaaatggggatatttcctagggttgtcctgagaataaaatgagttctgtgtgacagttaactgccattaattaattagccgttctaaaagtttatttacaatatcaaaatctgacaagtaaatcagcattgttgtttggttctcataatgtattgtttcttaagaacattttgtaattgggctatgattttatgatctacagacgtctatttaaactataatgtcttggtttaaataggataatacaatctaagactggtttgtccttgagaaatttcagatttaatcagagaaaaatgtactgattgggatttgagtggacattgtggggtgtatttctggataccctcaagatcttcatttaaattttgatactttctattactagatctaatttgattttaagctctaagtttcacttttccattaaacggaaagcctccctgacattaactgaataaaacctcatgttgtgggacttctgtgtgtgtttagggttggcagcaggtgattaggagaaggcatatgacagtagagaggactggaatatagaggagaatataagcatgtagatgaggatgtggctgtatttgttttgagttctaggagcacagcaccaaatgtggtctcttaagggaagatgagggtagaagatgttaagatcccaggttccagcaactgatgccactgactaacaactagccacttgtcagaggaaggagagaacagtgtcttggggatgctgatgggttggagtgcctaatggctcattaaaagccatgaaaaagcaaagaaatcaaagaatacttttgatggagctttaggctatgctaagctctttaatgtaaacaagcacctctaacgctaaaagcacccttgcaagaaaggtaggagttactattcacatcctagagtcaaggaaaaagagaagatgtttgacttgctcaaagtcaagcaggtaatgtcagaattgaatctcaaatctatatctttatagatttgcagttctggtttatataataccaaagtcacatacaggtaatttcccaccattgaaccttcctgttggtgtgagatgccaaatctgtgaaaac

SEQ ID NO: 731112 - DNA, 1087 bp, Homo sapiens; identical to SEQ ID NO: 728756

SEQ ID NO: 731113 - DNA, 1135 bp, Homo sapiens
  misc_feature (7)..(7): n is a, c, g, or t
  misc_feature (16)..(16): n is a, c, g, or t
  misc_feature (35)..(36): n is a, c, g, or t
  misc_feature (40)..(40): n is a, c, g, or t
ggcgccnccccggccnccctagcaccccggcctcnncatnagaggcgggagacccggagcagcagcagaggcaggaggactaggaggaggaggaggagccgtcgcaggatgaaggatcggactcaagagctgcggagtgcgaaagacagtgatgatgaagaggaggtggtccacgtggatcgggaccacttcatggatgagttctttgaacaggtggaagagatccggggctgcattgagaaactgtcggaggatgtggagcaggtgaaaaaacagcatagcgccatcctggccgcacccaacccagatgagaagaccaaacaggagctggaggatcttcactgcagacatcaagaagacggccaacaaggttcggtccaaattgaaagcgattcgagcaaagcatttgaacaggaggaggggctgaaccgttcctccgcggacctgcgcatccgcaagacccagcactccacactgtcccggaagttcgtggaggtaatgaccgaatataacgcgacccagtccaagtaccgggaccgctgcaaggaccggatccagcggcaactggagatcactggaaggaccaccaccaacgaagaactggaagacatgctggagagcgggaagctggccatcttcacagatgacgtgagccgcgggtggggcgggctctgcttttggaaaatttttgcctcccctccctaagttcaggttgaactaaggtcctaagtccaccctggaaaaatgagcagcgggaagcctgagccgggaactggggaattccatgggagcggagcaggaaggcacccccatcagatgacggagtcgttcgtgtgccaggcactgttctaagcactttccatcttcacattcacccaccaactcatttaatactcacacatccccttcgaggaaaccccatttcacagatgaggaaaactggcccagagagatgaaatcacttggcaagatctcagagcgagggagagggccaggacttgaatcctgtctagtttcagagtcagaactctcgagccctaggatacacgacatactctgctactgaagcaagtcgtttcaccagagaactgatttgcctacattaaaagaaattttttttaattaaaaaaaactt

SEQ ID NO: 731114 - DNA, 956 bp, Homo sapiens
  misc_feature (7)..(7): n is a, c, g, or t
  misc_feature (16)..(16): n is a, c, g, or t
  misc_feature (35)..(36): n is a, c, g, or t
  misc_feature (40)..(40): n is a, c, g, or t
ggcgccnccccggccnccctagcaccccggcctcnncatnagaggcgggagacccggagcagcagcagaggcaggaggactaggaggaggaggaggagccgtcgcaggatgaaggatcggactcaagagctgcggagtgcgaaagacagtgatgatgaagaggaggtggtccacgtggatcgggaccacttcatggatgagttctttgaacaggtggaagagatccggggctgcattgagaaactgtcggaggatgtggagcaggtgaaaaaacagcatagcgccatcctggccgcacccaacccagatgagaagaccaaacaggagctggaggatcttcactgcagacatcaagaagacggccaacaaggttcggtccaaattgaaagcgattcgagcaaagcatttgaacaggaggaggggctgaaccgttcctccgcggacctgcgcatccgcaagacccagcactccacactgtcccggaagttcgtggaggtaatgaccgaatataacgcgacccagtccaagtaccgggaccgctgcaaggaccggatccagcggcaactggagatcactggaaggaccaccaccaacgaagaactggaagacatgctggagagcgggaagctggccatcttcacagatgacatcaaaatggactcacagatgacgaagcaggcgctgaatgagattgagacgaggcacaatgagatcatcaagctggagaccagcatccgcgagctgcacgatatgtttgtggacatggccatgctcgtagagagccagggagagatgattgaccgcatcgagtacaacgtggaacattctgtggactacgtggagcgagctgtgtctgacaccaagaaagcagtgaaatatcagagcaaggcccggaggaagaaaatcatgatcatcatttgctgtgtggtgctgggggtggtcttggcgtcatccat

SEQ ID NO: 731115 - DNA, 492 bp, Homo sapiens
attaccatatcatagaaatttacttttttaacacaaaaatggaatattgtgcactactcagtagcttgttttttttcgctcagtggtatctcatgaataaccttccatatttttttaatggctgcataatatttcaagtatgaatatagcataatttataggcagtctcctcttgaaaaaatgtataaatgggaaaatgctttcccaaataatgtggatgtgaaaattcttatacttctatacttggtatttctgttgagcaggttcctataatgggtatttctaggtcctagttcatgtgcattttaaattttgatcacttctgccaaactaccctcagaaaaggtttgaccaaagttgccatctcattaacaaattatgacctgtttctcttgtccgttgtcactggatagtgtcttttttttctccctgagacggggtcttgctttgttgcactccagcctgggcgacagaaaaaaaaccgtctcacaa

SEQ ID NO: 731116 - DNA, 600 bp, Homo sapiens
  misc_feature (592)..(592): n is a, c, g, or t
  misc_feature (596)..(599): n is a, c, g, or t
cgaggcagaaaaattctactttccatctgcttggctgcggaggaccttggggtgggctcagcgtgggggctgcaggcagaaatgggtccagaaggcaaggtcgaggttagagccaagcctgtgggcagggctacgggcagggggcggggaggaatgtgggtccaggcccagaggaaaaggttgaagttatagccaggcctgtgggcgaggccgcagcagggcggccataggggaaggagccaatgtgttatgcatgtagaaaatagatggcctggagcaactgaagaaccacaaaagaagtgaaacagccagttcctgccttaactgatgacgttccaccattgtgatttgttgctgccccaccccaactgatctcttgaccttgtgacattcttcttctggacgagtctcaggagttccccaccgagcaccttgtgacccccggccctgccagcaaaagataaccacctttaactttccactacctacccaaatcctataaaactgccccacccctatctccctttgctgacccctttctcgcactcagcccacttgcacccaagtgaataaacagccttgttgctaacanaaannnna

SEQ ID NO: 731117 - DNA, 962 bp, Homo sapiens; identical to SEQ ID NO: 293559

SEQ ID NO: 731118 - DNA, 1054 bp, Homo sapiens; identical to SEQ ID NO: 76789

SEQ ID NO: 731119 - DNA, 883 bp, Homo sapiens
ccagggatctgagcagctccttctagcatccttcatccttcaggtaccagccatccagacagtgcttgagctgcagaaactgagaccagacctctggcctggccctccccaggggcctcctttcctatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctcctctgagctcccctgtcccttctcacaactcctcccttttccctctcctgggcccttccttaggtcagtaattgttgtgagccccttaggctccttgcatcccatccctaacccttgcctgaccatgtgaggttatctgaagcacaaggcccaccctcacctatctgtcgaccccatttcctaccacctttgtggccgaccccaagcaccccagagatatgaggcaccctttgctccacccacagcagggccccgtcagactctgccagcgcgtcctgcccgcttccctcggtgacctgctcagacaatggagagggatgggccaggttcttgctctcagtctcacctggagctactgggagggtaaagccatttgaagaataaagtcatccagagcctca

SEQ ID NO: 731120 - DNA, 1051 bp, Homo sapiens
  misc_feature (1051)..(1051): n is a, c, g, or t
ccagggatctgagcagctccttctagcatccttcatccttcaggtaccagccatccagacagtgcttgagctgcagaaactgagaccagacctctggcctggccctccccaggggcctcctttcctatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctcctctgagctcccctgtcccttctcacaactcctcccttttccctctcctgggcccttccttaggtcagtaattgttgtgagccccttaggctccttgcatcccatccctaacccttgcctgaccatgtgaggttatctgaagcacaaggcccaccctcacctatctgtcgaccccatttcctaccacctttgtggccgaccccaagcaccccagagatatgaggcaccctttgctccacccacagcagggccccgtcagactctgccagcgcgtcctgcccgcttccctcggtgacctgctcagacaatggagagggatgggccaggttcttgctctcagtctcacctggagctactgggagggtaaagccatttgaagaataaagtcatccagagcctcaaaaaaaaaaaatcgaggcctctcggggcgcaaacgcaagaaggccggcacgctccgcccttcgacaagggacgcggccaagggctatcaagcggcatagcgcaccacccccaccgcacaccagcgccacaccaacacacacacacacacaaccacacgggaaagcggn

SEQ ID NO: 731121 - DNA, 560 bp, Homo sapiens; identical to SEQ ID NO: 728758

SEQ ID NO: 731122 - DNA, 492 bp, Homo sapiens
aaaaaaaatggaacatctttttcagtctttggacctcaaaatacataattcagttactaagtgcgtgcacttttgggcctcacatctggattaaaatcttgcctttgccacatactgaccatgagaacttgggcgagttactgaacctttctgggactcagtttcttcatctgttaaaatgaggttaagagtatgaaccttaccaacaggtaaaaatgtgtcatattaattttttcaacatcaacaaacacgtcaaaagatggagcactgaaagctgcattttaaacaaatgccccaggtccatactgactttatgagccgtaacacttacagcgaaggtctgcagcttcactcctgaagccagcgagaccacgaacccaccgggagaaacgaacaactccagacgcatcactttaagaactgtgacgctcaccgcgaaggtttgcaacttcactcctgagccaccgagaccacgaacccaccggaaggaag

SEQ ID NO: 731123 - DNA, 2767 bp, Homo sapiens; identical to SEQ ID NO: 322670

SEQ ID NO: 731124 - DNA, 539 bp, Homo sapiens
tataataaaatgatgggcatgtccaaatttgggtatctgcctttctcgtggttaggctgttttcatttcttcacatgtaccttgaaaggctttaaatcatagactttacctggcccttgattatgaaggtgatgttaaattgctacctctcttaatccttggagtgtttaaatgaatgttctgtaattgatggatcaaagtgtccgtgtcccatagctttgtactttccctttgctgccagttctcacattaggttagaagacatcattcagaatttttctgagtatataaatagtcctattgtgtaacctctattagtagcacatgcgcaaattagtgaagcaaaaaaagttgttgtgacagctttagttgaaagattgcatcgggctctgacctccttccttgcacatgtttacaagcatttgataaaatgattaaaccctaaggtggaattactactttctgctacagtacaatttgtgtgttaatggatattagtgttattgtaatgtggattaaaataaaattttttaaaaatt

SEQ ID NO: 731125 - DNA, 1341 bp, Homo sapiens; identical to SEQ ID NO: 386518

SEQ ID NO: 731126 - DNA, 579 bp, Homo sapiens
tgagcctttcttctttcccttttcccagaaaaggctcaacatcaactatatagccaacatgtccaaggtgtttaagaagaccagctccaatgggaaggtgagagaacctggcccagctgggcaaatgagagggcaaaagggatagctctccatctacctggggaaacgggacttcgtggaccatgtggacacggtggaacccattgacggtgttgtcctggttgatcctgagtacttaaaatgtcgaaagttgtttgtcatgttgacatgtgcctttcgctatggccgtgatgacttggaagtgattggtctgacgttccgaaaagatctgtatgtgcagaccctgcaagtggtcccagctgaatccagcagccctcaggggcccctcacagtcctacaggagcgactactgcacaagctaggggacaatgcctacccctttaccctgcagatggtgaccaacctgccctgttctgtgacactgcagccaggtcctgaagatgcaggaaagccctgtgggattgactttgaagtgaagagtttctgtgctgaaaacccagaggagacagtctccaagag

SEQ ID NO: 731127 - DNA, 1065 bp, Homo sapiens; identical to SEQ ID NO: 728763

SEQ ID NO: 731128 - DNA, 453 bp, Homo sapiens; identical to SEQ ID NO: 386476
  misc_feature (1)..(1): n is a, c, g, or t

SEQ ID NO: 731129 - DNA, 394 bp, Homo sapiens
  misc_feature (23)..(23): n is a, c, g, or t
  misc_feature (67)..(67): n is a, c, g, or t
  misc_feature (335)..(335): n is a, c, g, or t
  misc_feature (394)..(394): n is a, c, g, or t
tgtttatttattaagttatttancttatttattgaaaggtgaggagtgccacggctgccccgtttanacctttaacgtctggtcctcctgcgtgtcctcccctccactgcctgcatggggggcgcggggagtgacccaggcggggcctcaccgccccagggccgttgcctgctcagaccttgcaggctgtggagcaagaggccctgggtctctccaagcagctgcagaccccagctcgaattttgcacatggcggggtcccgggaagggtggggagcaggtgtccttcctgtcgtcgtctgccgtgtgccatctttcctggatcttgtagcgggngacacgcgtgcactgggaccacacagcaatacgagtccaacttaataaacacatttctn

SEQ ID NO: 731130 - DNA, 487 bp, Homo sapiens
tgcccctggccttgaaactgtggtttgtggactccaaagcccctatccttccacagtgctttctgtcttgttatcacatttccttggaggagagcccagccttggtggagagccctgctctggctttgtccctcggcatgagatggcaaaggatggtgctgctgggagaccctcacgtctgcacactgggggctgcttgccttctccattcctccttcaagtatctgagcagctcctgtgtgccagctgctggtctacaagatggatcggtccttggagatcatgctgtagcagaggaggcaggctgtagcccacacgccacaaccagccccctgcctgttcacacaaataaagttttattggaatacagccacacccatttcagtgcatattgtctgtggctgctttcctgctacaatagagagttgaatagttgggacagagacctatggcctgcaaagctgaactatttaccatctggctctca

SEQ ID NO: 731131 - DNA, 789 bp, Homo sapiens
gccggacgccgtcttacgtccccgcgctgtctcggcggcccaggaattcactgtctgtagcatctgctcctccacagagggaccctggaatggcgatggcactcccgatgcctggacctcaggctttcttgttgccaaaccagcactgatctccctattggagcaaggagaggagccgggggccttgattctgcaggtggctgaacagagcgtggccaaagccagcctgtgcacagaggaccctaatacactgcccagcagaagccaggaaggaagccctgccagctcagaaggtgggccaggagagaagggtgtggccggaaggttagccggtgggggtgctgcatcctcttggccccacggggagcaccctgtcacccctaacagatgaagagaagggtttctggtgtctccagatttttcaggcgcccaccatgttcctctcatccagacgtcggcacccaaggtggaagcaggtcatggcatgcccggcccagctgcagtccgagtgcagatcccatggcgagcgtgggatccagcccaaagcacaagccacgcacagcccgcccaggttgagtgggcaggtacctccaacagccagcccaggttgagtgggcaggtacctccaacagcctggagccgtgaggccttgcgcagggcgttgccggccgtggaggtctctggctggcaaagtggcaccgaaagagtcctgtgtcataaccagactcacttgtagcttctgttgctctccctagctatttgcaaagcatccaggataggttcatctaa

SEQ ID NO: 731132 - DNA, 665 bp, Homo sapiens
catataaactccatatccgattccccatatctaggttagaacgtctcttttctccctgtcaatcatgaggactaatgcagcacacaatgtatacagtactaataaaggctttggacttaccacttccttctttgaaatcccaactggtcgcatcttaggttggtttggggcagtcccttgtgggaactctcctgctattctgtctggttttgggccttactgcagttgtggttttgggtggttggaacaagcatatatttcaataaatacgttttttaaatgtccaaaaaacaacatgacacaactgcgggtcgagagccagttttagtttgtcccataagctttctgtctttgttcagtttagttacaatggagaaaacctctttaatgttgacaggatttctttagaaaaaaaccattgctatatctgaaagtccagtttcaactggcaaaattggacaaaagcagcaatttgaaaaaccaagctacttataacttgataaagtcctctataaactaagtcattatatttctccttttaaataaaccattgtaaatttaatgttcatatcagttgagtattagtttccagctggattcatgctgaataaagtccagaaactttctttgtgattcaaatagatgcacaggaagctgggaaggaa

SEQ ID NO: 731133 - DNA, 895 bp, Homo sapiens
acagaaattcttttgggaatgagttttagggccattaaaggacatgacctgaagtttcctctgaggccagtccccacaactcaatataaatgtgtttcctgcatatagtcaaagttgccacttctttttcttcatatcatcgatctctgctcttaaagataatcttggttttgcctcaaactgtttgtcactacaaactttccccatgttcctaagtaaaacaggtaactgcctctcaactatatcaagtagactaaaatattgtgtctctaatatcagaaattcagctttaatatattgggtttaactctttgaaatttagagtctccttgaaatacacatgggggtgatttcctaaactttatttcttgtaaggatttatctcaggggtaacacacaaaccagcatcctgaacctctaagtatgaggacagtaagccttaagaatataaaataaactgttcttctctctgccggtggaagtgtgcccctgtctattcctgaaattgcttgtttgagacgcatgagacgtgcagcacatgagacacgtgcagcagcctgtggaatattgtcagtgaagaatgtctttgcctgattagatataaagacaagttaaacacagcattagactatagatcaagcctgtgccagacacaaatgacctaatgcccagcacgggccacggaatctcctatcctcttgcttgaacagagcagcacacttctcccccaacactattagatgttctggcataattttgtagatatgtaggatttgacatggactattgttcaatgattcagaggaaatctcctttgttcagataagtacactgactactaaatggattaaaaaacacagtaataaaacccagttttccccttaaatccctagtt

SEQ ID NO: 731134 - DNA, 638 bp, Homo sapiens
gctcttgagaagaggagcttatcctgcattatccaggtaagccctaaatgcaatcatatgtatccttataagacaggggcagagggagatttgacatgaagggaaggcaatgtgaaggtgaaggcagagataggagtgatgtggccacaaatcgaagaatgccacggaatgccagtagccaccagatgattgagaagcaaggaacaaattctttcccagggcctccagagggagtatgtccctgctaatactttgatttcagacttctggcctccagactgataatgcatttctgtttaaagccccccagtttgtggttatttgttacagcagccgcaggaaactaatgtatcattctgaggtcccccaaatctcaacccattgcagttcaagatagagtccaaaatctcattagctgagaagtatggcgtaccagaaaagaagtgactactgtaataaaaggcatacatctaaagattagaagacatgatgaaaacatcttccatcagtgctatagtttgaatgtttgtcccctccaaaattcttgttgaaagataattcccagtgtaacagtattgagagatgggccctctaagaagtgattgagttatgaggactctgcccttatgaatggagta

SEQ ID NO: 731135 - DNA, 435 bp, Homo sapiens
cactaataagctcaataaatgtttggcctgtctagtataataaatatgtttttgtcagaatttgacccatttatgatgtaagcaaaaatgatatgtcttaatccatttgtctcacacactaattttataatttaaaagagcaatagtagtttcattcagaaagacaggtttaaggccaggtgcagtggctcacacccataatcccagcattttggatcacctgaggtcaggagttcaagaccagcctggccaaggtggtgaaaccccgtctctactaaaaatacaaacgtggcaggcgcgtgtaatcccatctacttgggaggctgagacaggagaatcgcttgaacccggggggcggaggttgcagtgaatcgagatcccaccactgcactccagcctgcgcgacagagtgagactccgtttcaaaaaaaaaaa

SEQ ID NO: 731136 - DNA, 602 bp, Homo sapiens
tctgttatatcaggaaactggtctgttttatattctactcatgtttctaaattgtttaaacttttatagttggaatacattccacttataatcagcaaaaataataaagatattaccaatttaaaaacatagtagtgattatctttaaattttttctatgagaagtattttccctacttcctttaaaagggcaagctaagttttttttttttttttttttgagatggagtctcactctgtcacccaggctggagtacagtggaacaatcttggctcactacaacctccacctcccaggttcaagcgactctcctgccccagcctcccaagtagctgggattacaggtgcacactgccatacccggctaatattttgtatttttagtagagacgaggtttcactgtgtaaaagggcaagctaagttttgtgttttaaaattggaggtgggatgaggggagcggtgggcttcctagggtagcatgcacaagatcagacaagttgttatgggttgaattgtgacccctaaaaagaaatattgaagtcttaacatccatatcttagaatacaccctcatttggaaataaagtacttgccaatataa

SEQ ID NO: 731137 - DNA, 667 bp, Homo sapiens
gtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggc

SEQ ID NO: 731138 - DNA, 403 bp, Homo sapiens
gccgctggccacggacgagaagatcctcaatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggtgtgcaccaggctcgggggggacagggctggggggcaggggcgggca

SEQ ID NO: 731139 - DNA, 992 bp, Homo sapiens; identical to SEQ ID NO: 288005

SEQ ID NO: 731140 - DNA, 1014 bp, Homo sapiens
agcgtgggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggcttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaac

SEQ ID NO: 731141 - DNA, 848 bp, Homo sapiens
agcgtgggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccggattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaac

SEQ ID NO: 731142 - DNA, 2626 bp, Homo sapiens
  misc_feature (1940)..(1940): n is a, c, g, or t
agcgtgggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccggattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagatngtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtcccatgtcttga

SEQ ID NO: 731143 - DNA, 2702 bp, Homo sapiens
  misc_feature (2016)..(2016): n is a, c, g, or t
agcgtgggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggcttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagatngtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtcccatgtcttga

SEQ ID NO: 731144 - DNA, 724 bp, Homo sapiens
gtccaatgatgaaacttaagagacattttgtagcccagaaatacaaaaaacaaattgatcacatgtaccactgactgctttgatggagctgctctcagctgttctgatggtgagattcagttgcttggctttgctgggctatgcattcagagtccaagagagggctccactgtgtggcaggcagatctgtgactggaactgcagaaaacacacacatacacacatacatacacacacacacacacacacacacacacacacacacacactcttagttgcagtggattctgagtagcaggcttcaactcatgctgtctctactctaccagggtcatggtagggtgtgtaaactccttcagctggccaccaatgttgttagctgtgcttcctgccttttctatttgtttctagaaagtaggaggcaatgaatcccaaatgtctcattgggtcttatttggagaaggcctttgtcagaaactttagtggagaaagttctacttgccaggaactcaaggaatgaggtgtgttggcccattacacagataataagggatggaggcttgaacttccactatccaccgtttatcctctcttttccccaagacatgtgcagagggagcctccatgacaccatgaatcactgatagttattgaggtgttttttttttttttcttcactagatgcacagtgcaggcagaaagtagaatgcatcttcaattgtcc

SEQ ID NO: 731145 - DNA, 583 bp, Homo sapiens
gtggggagattttgggtgacagccaatttataaatggatcgattcactcgggaatattttcatcatatggtgactgtgggatcttggagactgaatgcacatattacgagaatccccatgtgataacttgtgtttctcctctttgcagccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtcccatgtcttga

SEQ ID NO: 731146 - DNA, 754 bp, Homo sapiens
ctccctcaggcatgtgacttttctatggcaggcccctttacagtcacattatgccccatccttcctataacatgggagagtctttctttttaggatttagtggctcaacaggtttggaaggacttgggaaggggaggcttccctgagttctgttgctgggagaagacaggcaattcagtaggtcaaatggcaaaggtaaaaccacagtggaaggcttctctgtggacagagactgaagggtgtggaggtatcgaagctgaacagcagcaggggtgcctgacagaatctcagctgccatcctcagggactcagaagcagccttttccgcttctgcagcaatcatctagaaaacatgtgacgaaagcaaagtgattgttcttcattccctgaaggcttcaccactatgcagtatgactcagcagacaagcactgagcatctactatgtggcaagcacgcctccacagccagtgagtgctgaagcccagctggcaacctcacatctttactgaaaaagaaagaatgcaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattgaaaaaa

SEQ ID NO: 731147 - DNA, 493 bp, Homo sapiens
ctccctcaggcatgtgacttttctatggcaggcccctttacagtcacattatgccccatccttcctataacatgggagagtctttctttttaggatttagtggctcaacaggtttggaaggacttgggaaggggaggcttccctgagttctgttgctgggagaagacaggcaattcagtaggtcaaatggcaaagcctccacagccagtgagtgctgaagcccagctggcaacctcacatctttactgaaaaagaaagaatgcaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattgaaaaaa

SEQ ID NO: 731148 - DNA, 344 bp, Homo sapiens
gcctggcctaaaatgggaaatttcatgtaaattttatctaaaacaatttttagattcatagagaaaaaaataatcagagtaatttgtccaaatgttatagtgattgtgttatggctgtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattgaaaaaa

SEQ ID NO: 731149 - DNA, 698 bp, Homo sapiens
ttactaagaagtgataaatatattcttaaatagcagcatgatttctactctgacattagcattcagagtcgctcctgggcccccagttctcagttaatcattgatgctgttgcttcccttatttctacccttcagacacattcatctaatctcactgcctttttagaaaatgagtttcgaaatcaaaaatactttttcaaccctttctattttgttgtgtcttctcttccatatcagggaggttgaaaatagagccagacaggcagaggagaagtttgaagatgcatatgagaaacttcatcatacccttataaaaaataaagatctagaggaattagtcatgacatcaagaaaggagtctaaagaagagaaagaaaatcaagatgaaagagaagtaaaagaagaagaagaacaacaagaagaagaagaagtcaggtcagcagaaaattcctcaaaatctccaaagaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattgaaaaaa

SEQ ID NO: 731150 - DNA, 433 bp, Homo sapiens
gttttgtattgatgagctgtgctcagtttttccgcttaggatataatctaagccccaactaataaatttgaacaatggcttgaagagccacactactgataataaagataaggggaattcatccaagtttataaaagagaagaattgattttgaaaagggtacaactgaccaaataagaacaacgcttaatgtattgcataaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattgaaaaaa

SEQ ID NO: 731151 - DNA, 657 bp, Homo sapiens
accaatactccagctatttgagcagttgttgcaaagggatggtaacagcaatggctctgagtaaatccactaactcacacaaaaatgctactgaagacctttatgaggtggataagttgaaggaggctgtaaaagaattcattgagcctgaaatagacgagtcttttaaagaagatgaagaagaaagtaaggaggataggaaacttcaggaggaaaataaagagagagcagaagaacaaccttcaacatctacagagaaggaaaaactcattcgattcattggagaagatgaaaatgttcattccaaacctctatttgaaacagatgtgttgtcttcctggagagagtcagctaagcaaggtacattggcccaaaaatatcttgaagcaatggctgtaattgaacatatgcaggagaagttactggaggttgaaaatagagccagacaggcagaggagaagtttgaagatgcatatgagaaacttcatcatacccttataaaaaataaagatctagaggaattagtcatgacatcaagaaaggagtctaaagaagagaaagaaaatcaagatgaaagagaagtaaaagaagaagaagaacaacaagaagaagaagaagtcaggtcagcagaaaattcctcaaaatctccaaagaaag

SEQ ID NO: 731152 - DNA, 891 bp, Homo sapiens
tgttactcacctttattttggtcgttcagtcagcaaagtggttttaggacgggtcaaatatttgattgtttgcaaactgtcgtaatggattgctgcagaaacatttggaaaaaaataagaaatttgaaaagcaagaaattgctgtaaatagggcacaagccctgtatatggattagatggtcgatatgccaaaaactacagatggtttctaagtagatttctcacctttccttggaggcatattgtagcttgctaaattgttaagcaaaaccacatgggccacaggaaggaattcctccaatcagctgtggggtttcgtgaagtgtgtgcatgaagcagaagttttcagagaaaatggtgaaacgtccttgaaagtgcctcagctgggagaggatcagaaaaaaatatctatcgggttttatcattttgaaagaagtacaaaatctctacgtatggaacctgcattaaataaatgagcatcaacatctccaggaggcaccccaggtgtagactccacctctcttacctcttccagatattcgaacaccattattgatagcattcttgttttgataaggtttctcctggcccacaatcattccagtgaatggtgcgtacacagtagatccagcagagcacaagacgtccacaccctggtgaggcctctgacttctaggatgtaaataagaacgaacagactgaggaactgccttaggggagctttactgcctgggaacatggtgttagcccactgtttgcagacgaggtaccaaagcttgaagctgccagaacatgttgggatgtcccaggatgcctcactctgtttagcccaattttaacctccctccccgcaggtgctaataaccatatcataaagatgaaagcatttaa

SEQ ID NO: 731153 - DNA, 1239 bp, Homo sapiens
ataatcatctaaaactggaaactgcccaaaagtccatctgaggaagaatagataaatagatgaaagtatacgcatataatggaatatcatgcatcagaaagaacgtggatacaaaaacataaactgcataatcacgatgtggaatgaaagaagacccaaagagtgcatgctgtttaattctatttataccatttttagaaacaggaagaactaatacatggtgttagaacttgagatagtgattatcttgctgggaataatgactaagtggtagcacaagggatctctgggatgtgggtgatgttctttttcttgatctgggtgctgattacacaggtgtgttcactttttgaaattcacggagctatacatggatgtgttgtgcacttttatgtgtgtatttataccttgatggagtaaccaaacaacaaaaccaatacctggagtaccaggagatctagctttacctaaaacttagaagctttcaaaaatatttcacattcaactcttgcagaagtgccagcatttatgatttgtgggatttgagtaaatgcaagtatctatccattatggttagcattgctgaaagtggctttgtttatagattgttaagcaaaaccacatgggccacaggaaggaattcctccaatcagctgtggggtttcgtgaagtgtgtgcatgaagcagaagttttcagagaaaatggtgaaacgtccttgaaagtgcctcagctgggagaggatcagaaaaaaatatctatcgggttttatcattttgaaagaagtacaaaatctctacgtatggaacctgcattaaataaatgagcatcaacatctccaggaggcaccccaggtgtagactccacctctcttacctcttccagatattcgaacaccattattgatagcattcttgttttgataaggtttctcctggcccacaatcattccagtgaatggtgcgtacacagtagatccagcagagcacaagacgtccacaccctggtgaggcctctgacttctaggatgtaaataagaacgaacagactgaggaactgccttaggggagctttactgcctgggaacatggtgttagcccactgtttgcagacgaggtaccaaagcttgaagctgccagaacatgttgggatgtcccaggatgcctcactctgtttagcccaattttaacctccctccccgcaggtgctaataaccatatcataaagatgaaagcatttaa

SEQ ID NO: 731154 - DNA, 1185 bp, Homo sapiens
ataatcatctaaaactggaaactgcccaaaagtccatctgaggaagaatagataaatagatgaaagtatacgcatataatggaatatcatgcatcagaaagaacgtggatacaaaaacataaactgcataatcacgatgtgtagaaacaggaagaactaatacatggtgttagaacttgagatagtgattatcttgctgggaataatgactaagtggtagcacaagggatctctgggatgtgggtgatgttctttttcttgatctgggtgctgattacacaggtgtgttcactttttgaaattcacggagctatacatggatgtgttgtgcacttttatgtgtgtatttataccttgatggagtaaccaaacaacaaaaccaatacctggagtaccaggagatctagctttacctaaaacttagaagctttcaaaaatatttcacattcaactcttgcagaagtgccagcatttatgatttgtgggatttgagtaaatgcaagtatctatccattatggttagcattgctgaaagtggctttgtttatagattgttaagcaaaaccacatgggccacaggaaggaattcctccaatcagctgtggggtttcgtgaagtgtgtgcatgaagcagaagttttcagagaaaatggtgaaacgtccttgaaagtgcctcagctgggagaggatcagaaaaaaatatctatcgggttttatcattttgaaagaagtacaaaatctctacgtatggaacctgcattaaataaatgagcatcaacatctccaggaggcaccccaggtgtagactccacctctcttacctcttccagatattcgaacaccattattgatagcattcttgttttgataaggtttctcctggcccacaatcattccagtgaatggtgcgtacacagtagatccagcagagcacaagacgtccacaccctggtgaggcctctgacttctaggatgtaaataagaacgaacagactgaggaactgccttaggggagctttactgcctgggaacatggtgttagcccactgtttgcagacgaggtaccaaagcttgaagctgccagaacatgttgggatgtcccaggatgcctcactctgtttagcccaattttaacctccctccccgcaggtgctaataaccatatcataaagatgaaagcatttaa

SEQ ID NO: 731155 - DNA, 1079 bp, Homo sapiens; identical to SEQ ID NO: 416865

SEQ ID NO: 731156 - DNA, 438 bp, Homo sapiens
gcaaatcaaatagctatccatggaatattagaacttgacttgctccatcctcttaaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtcactggcagggccatgggctaatatatgtgctggcaagtcttccaatgagatccggacgtgtgaccgccatggctgtggacagtactctgctcaaagaagtcagaggcctcaccagggtgtggacgtcttgtgctctgctggatctactgtgtacgcaccattcactggaatgattgtgggccaggagaaaccttatcaaaacaagaatgctatcaataatggtgttcgaatatctggaagag

SEQ ID NO: 731157 - DNA, 488 bp, Homo sapiens
ataaggcccagccccgccttctgctgttgccgcagcaacccagaaagcgtcatggctgccgccggccaggaaaaagggtatttgacacagactgcggcagcctagacaagtcaccgtcactttcgccacagctagcagctcccatccgagggaggcctaagaagtgtctggtctatccgcatgcgccgaagagctcccgcttgtctcgttccgttctgcgttggcttcagggtctggatctcagcttcttccccaggaacatcaacagaaatattctgtatatattacccctgggaacttgaattatcatcctttgaaaacgggacctctttaaaagtcaagttggataactgggcacagttggagaagttcctggcaagaaaaaaatttaaattacctaaagaactaatccatggaacaattcattgtaaagctggagtgcctgaaatattgatagaagaggtttacactttattaacacatcgaga

SEQ ID NO: 731158 - DNA, 1085 bp, Homo sapiens; identical to SEQ ID NO: 464531

SEQ ID NO: 731159 - DNA, 1174 bp, Homo sapiens
ataaggcccagccccgccttctgctgttgccgcagcaacccagaaagcgtcatggctgccgccggccaggaaaaagggtatttgacacagactgcggcagcctagacaagtcaccgtcactttcgccacagctagcagctcccatccgagggaggcctaagaagtgtctggtctatccgcatgcgccgaagagctcccgcttgtctcgttccgttctgcgttggcttcagggtctggatctcagcttcttccccaggaacatcaacagagatttttcaaatggcttcctaattgcagaaatattctgtatatattacccctgggaacttgaattatcatcctttgaaaacgggacctctttaaaagtcaagttggataactgggcacagttggagaagttcctggcaagaaaaaaatttaaattacctaaagaactaatccatggaacaattcattgtaaagctggagtgcctgaaatattgatagaagaggtttacactttattaacacatcgagaaattaaaagtatccaggatgactttgtgaatttcacggactatagctaccagatgcgtttacccctggtttccaggtctacagtttcgaagtctattaaagataacattaggttatcagaattactaagcaatcccaacatgctgaccaatgaacttaaagcggagttcctcatccttttacatatgttgcaaagaaaattaggcagaaaattgaatccagaatggtttgatgtgaaaccaacagtgggagaagttactctcaatcaccttcctgcccaagcctctgggcgcagatataatttaaaagttaaaagaggaagagttgtccctgttttaccaaatataggtagtggtggcagttcacatagagaaatacatgtgaagcaagctggacaacattcttattactctgctatgaaacctatcagaaacatggacaagaaaccttgaaaagcacctgtcaaatggctttgaagaagtgatgccaccatctctagccataataaagaaacagaatcacctagtattggatgtatttcaataataaatagagtggtgtcttttccataattgtgttaaagaacatttcttttccattcaatttgtttattaaactcctatgccaggcattgttgaaaatacaaaattaaataaat

SEQ ID NO: 731160 - DNA, 632 bp, Homo sapiens
gcacactataaatgtctttccttatctgtgtgtactcttatctcactgttctattttttctcctcatttatattaactctttcttacctttttttctgaacttctaggccttctctttccagaactggtggaagacaaatgaaacggccaagatggtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaaccttctgctgggcactgcgtgtgccatctacttgggcttcctggtgagccaggtggggagggcctctctccagcatggaagggcggctgagaaggggccacatcgcagccgcgacaccgccgagccatccttccctg

SEQ ID NO: 731161 - DNA, 1165 bp, Homo sapiens
gcacactataaatgtctttccttatctgtgtgtactcttatctcactgttctattttttctcctcatttatattaactctttcttacctttttttctgaacttctaggccttctctttccagaactggtggaagacaaatgaaacggccaagatggtaaggtgagtagttcctgggaacgcttgtgctctaaccccaagttatgtgggatggacactcgaggggtgatggcattcctcattttacaagttacttgcttggctgcggctgctccaccaagatagcaaacattctcgatcttttgaacttcatgagactgacatttctgagtctgtttgcgaacaggacactagagggctcccaggggttaaaaataagtggaaatttatttgaatgaaaactgattctctacggcatttcttttttccgaatttaaaattaaagtttattttgttaactattgtttttaaaagctttgtatctcttaaaaccatgcagcagtcagtttccaagttttgctttgcaatcagtagttttcaagggagcttttaaagctgaactgaaatgtttgaaatgtggaacactcttgaccatgaaatatgttctacttacatgcctcagcctttaaaagttctttgcattagagtcaaggattacattcttcctggagccaagcatggggccagctgtgtaaaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaaccttctgctgggcactgcgtgtgccatctacttgggcttcctggtgagccaggtggggagggcctctctccagcatggaagggcggctgagaaggggccacatcgcagccgcgacaccgccgagccatccttccctg

SEQ ID NO: 731162 - DNA, 1184 bp, Homo sapiens
  misc_feature (3)..(3): n is a, c, g, or t
  misc_feature (23)..(23): n is a, c, g, or t
agntccaaataggagtgaattangctggccacatagtgttacttccacagacttgtaagaaccagttctgaggagaacaggtgattttctcccaaaagcacttttcctttttttctgaacttctaggccttctctttccagaactggtggaagacaaatgaaacggccaagatggtaaggtgagtagttcctgggaacgcttgtgctctaaccccaagttatgtgggatggacactcgaggggtgatggcattcctcattttacaagttacttgcttggctgcggctgctccaccaagatagcaaacattctcgatcttttgaacttcatgagactgacatttctgagtctgtttgcgaacaggacactagagggctcccaggggttaaaaataagtggaaatttatttgaatgaaaactgattctctacggcatttcttttttccgaatttaaaattaaagtttattttgttaactattgtttttaaaagctttgtatctcttaaaaccatgcagcagtcagtttccaagttttgctttgcaatcagtagttttcaagggagcttttaaagctgaactgaaatgtttgaaatgtggaacactcttgaccatgaaatatgttctacttacatgcctcagcctttaaaagttctttgcattagagtcaaggattacattcttcctggagccaagcatggggccagctgtgtaaaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaaccttctgctgggcactgcgtgtgccatctacttgggcttcctggtgagccaggtggggagggcctctctccagcatggaagggcggctgagaaggggccacatcgcagccgcgacaccgccgagccatccttccctg

SEQ ID NO: 731163 - DNA, 541 bp, Homo sapiens
cccattttttttcttagaggaaatgtttgatagtttctcctaaaaaattaataattggcacaaaagactagttttgtgtcaaaagtagttttgagttttatctaaagactgacattggcttgaagttgggctttccagattcaaaaatctgccccagatgagatttagatgcagagggttagtgtccttttccccagggggatggccgtgatgatttgttcaagattgtgttatagtagctgccccttttaagccagctgtgtgtgtgtggtggggggtgggcagtgtgtattccacatcaacatcctagaaagaacgaataaacatttagtgatctcactgtttctacttacatttggtataatgtactgtttttattggtgctattacctatgttaatagggcactttacaaaattttcaagaacgtttttattaaaattatttcaaagacttctttcttaaaatatgattttaccatgtaaaaaattatactaaggtagaagaatattcgttctttctcattttctgaaaaaagaaaa

SEQ ID NO: 731164 - DNA, 656 bp, Homo sapiens
tcaacatggccctggagctctacatggacctgctgtcagcaccctgccgtgccgtctacatcttctcgaagaagcatgacatccagttcaactttcagtttgtggatctgctgaaaggtcaccaccacagcaaagaatacattgacatcaaccccctcaggaagctgcccagcctcaaagatgggaaatttatcttaagtgaaagttgctgatcccaaagataacaggggaggaagtttcagctgagaagatggagcatgcagtggaagaggtgaagaacagcctgcagctctttgaggagtattttctgcaggataagatgttcatcaccgggaaccaaatctcactggctgacctggtggccgtggtggagatgatgcagcccatggcagccaactataatgtcttcctcaacagctccaagctagctgagtggcgtatgcaggtggagctgaatattggctctggcctctttagggaggcccatgatcgactaatgcagttggccgactgggacttttcaacattggattcaatggtcaaggagaatatttctgagttgctgaagaagagcaggtgaccctaggcgcagcctgtcccgcagggcctggctggcttagcaatctgagccaccttccttaaaggaaatgttaaaa

SEQ ID NO: 731165 - DNA, 718 bp, Homo sapiens
ttgctgatcccaaagataacaggggaggaagtttcagctgagaagatggagcatgcagtggaagaggtgaagaacagcctgcagctctttgaggagtattttctgcaggataagatgttcatcaccgggaaccaaatctcactggctgacctggtggccgtggtggagatgatgcaggccagcagcacagcgatgcctttgcccaggtgaaccccctgaggaaggtgccgggccttgaaggatggggacttcaccttggctgagagatttagtctcttactggttatgtatgctgcacctgaggagtagcagcactgccaaggacactgagtgtcttgtctgtgcagagcttcacatgaagctggagagaagggactggggcaagagggaaagataaaaaggggcaaatggctctcctcacctggacccacaggggtataccaaaggtgccacggatgcagtcggcatgccagcccaggtactcatgaacacgggcacgagcctgcaggtcagatggataccagtggtccggcgtctggtacttacagctcagaaggcaagctaaggttcagagaggctgtgatcccttcaaggccactcagtccacagcattctctggtggcagacgctgcaggaggaggagtctcactctgtcgcccaggctggagtgcagtggcacaatcttggctcactgccaactccacctcctgggttcaag

SEQ ID NO: 731166 - DNA, 3114 bp, Homo sapiens
cacccggcaaacagcagcaggaggagccgctagagcagctgctcatgggcagagctgccctcgggcaactcctgccaccaccccctccccagggagcccaaggcaggggaggctcagcatggaatgaaacaggggagtgagggacacaaggaggtgggaagtgggagggtcccagccccaccaagtacgcagagaacccctcgttgtcctggacaccacaggggcacctgcaggctgggagaccaggtcctctgtgcatgggcccgggaggcagacctgccctaagggtgatgcacaggctacaggtgctgcacgctccagcgcccactctagacatcagcctccaggttgactaagggtcaggtcatgtttgaaaccatgcttggctggaccaggacccatggcaagagcacctgggcaccagtgtttagccctggtctgcaggaaggaggacagcagactttaggaccccacagcacggcagtgctgaccatttcacccacttggcctccttgagaaatatggatggggacccctctggggatgggcaaggccttccaggataggctcagttttggtcccctgctttttgaggttgggttaaaattccgaccatggcagaggaagcacagctcaggttcccacacctcacttttcacagcctctgagggcagcagtgcacgtggaggagacgtctcccatgaggccaaggcctccagtgctcaccgatgccctctgcgaagttggggtagaactcgtcagtgaagaggggctcgggcagctcacggaaatacagcttcagcgtgcctgcgatggcgttcacgtccatctcgctcatcatcaccgacacgtccttgttatctggaaagagcacggaaatgcagcggcctccttgaagatcctgataaatgaagaaaagacacagagaaggatgtgacatgcctgggccgtggagcactctgagatctcatcgcggacaccactgcccacacctccatcccgtcctgcgcaggccgacactcactgacgttgaaggctgccttcagtgcctggatgtctgcggccaccccagacatgcggtagatgcccacctcctccatgcctcggcgctcgatctcctccacgcactggcgcacgatgtagggcaccttggacctctctctcctgcgggaggagggaatgttctcagtgtcctaacagccctgcttgggccataacacaggagacctgctccctatgtgcacacccggaggtggggtgaggacggtgatgaaggtacccaggtctggggctgcacacagagccttctgcatgcctgtcctccctctgcaagctctgtcctcattgcatgtgctttctcaggaacctttcaagcggccagaacccctgcaaatcacacatgacctttgtgggaaggtcaggaggcctgtctaagtcaagtcagcacgggaagggcatctgacagattccaggcctggggtgagcagcctgtgcccccggctgggaggtcagacccggtgttggtcctgccacccacgtgctgtgtgagaggagaatccgtgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggctcatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctgaggaagcaagtgaattctcagaggaagtggtctgtgtctgcatgaactgctctcaaaccaacaaataggcttctcttggcaactgactcgtgacaaagggttcaagattgtttgaaaaaaaaaaaggggggggggggacagggaggcagtaggtcctggaaaagtaaattctttattttacaataagaaagtgattacatattttatttttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgagactctgtctcaaaacaaaaaaaaaaaaaaaaaaagaagaagtcattcccaacattgctcatcaaattatgaccataaatttccaggatcagactaacggctaaagagactgatgcatcaacaccaggcagagaataaagcagattttttttgttttgttttggagagcctctaggaacttgaaaaatacatatgccacactcttaagacccggtggttcttaatcagggatgttcattaaaatgctggaaaactctaaagatttccaggtcccatccaaggagattttgcttctgattgactggctagtggcctggccattggtattttgaaaaatccctccaagtgattcttttacatcccagctagaaaaccctaaattaaaggtgaaaaaccagacaccaagtggcatttaaataaatgtcaactttaactccacaaagcatctggttgcatgtggacagaaagagaaggaaagagggccctatatctggataacttggaaatgtgctccccctagcaagatatctaccaaaattaaaaccatatttgaggatgctggcactgtgagcaatatataaatgatgcatgtaacatcatttaatatgatcttatttttaaa

SEQ ID NO: 731167 - DNA, 2255 bp, Homo sapiens
tgtttgtacaactcttgttttctcttttttaaaaataataaaacagtaaatgaagaaaagacacagagaaggatgtgacatgcctgggccgtggagcactctgagatctcatcgcggacaccactgcccacacctccatcccgtcctgcgcaggccgacactcactgacgttgaaggctgccttcagtgcctggatgtctgcggccaccccagacatgcggtagatgcccacctcctccatgcctcggcgctcgatctcctccacgcactggcgcacgatgtagggcaccttggacctctctctcctgcgggaggagggaatgttctcagtgtcctaacagccctgcttgggccataacacaggagacctgctccctatgtgcacacccggaggtggggtgaggacggtgatgaaggtacccaggtctggggctgcacacagagccttctgcatgcctgtcctccctctgcaagctctgtcctcattgcatgtgctttctcaggaacctttcaagcggccagaacccctgcaaatcacacatgacctttgtgggaaggtcaggaggcctgtctaagtcaagtcagcacgggaagggcatctgacagattccaggcctggggtgagcagcctgtgcccccggctgggaggtcagacccggtgttggtcctgccacccacgtgctgtgtgagaggagaatccgtgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggctcatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctgaggaagcaagtgaattctcagaggaagtggtctgtgtctgcatgaactgctctcaaaccaacaaataggcttctcttggcaactgactcgtgacaaagggttcaagattgtttgaaaaaaaaaaaggggggggggggacagggaggcagtaggtcctggaaaagtaaattctttattttacaataagaaagtgattacatattttatttttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgagactctgtctcaaaacaaaaaaaaaaaaaaaaaaagaagaagtcattcccaacattgctcatcaaattatgaccataaatttccaggatcagactaacggctaaagagactgatgcatcaacaccaggcagagaataaagcagattttttttgttttgttttggagagcctctaggaacttgaaaaatacatatgccacactcttaagacccggtggttcttaatcagggatgttcattaaaatgctggaaaactctaaagatttccaggtcccatccaaggagattttgcttctgattgactggctagtggcctggccattggtattttgaaaaatccctccaagtgattcttttacatcccagctagaaaaccctaaattaaaggtgaaaaaccagacaccaagtggcatttaaataaatgtcaactttaactccacaaagcatctggttgcatgtggacagaaagagaaggaaagagggccctatatctggataacttggaaatgtgctccccctagcaagatatctaccaaaattaaaaccatatttgaggatgctggcactgtgagcaatatataaatgatgcatgtaacatcatttaatatgatcttatttttaaa

SEQ ID NO: 731168 - DNA, 2091 bp, Homo sapiens
acagcaggttgagcatgcagctcttctttgcaactgggtctgaaagagctgcaggaggcagtgggtcactcccctgggttacgacaagccggagacctctcccgaggtggtcacatggagcgccagggacacgagtccttgcgcagtttaggcttgtcatcatcgtcacacccacagcgctggccgccagtgaggaccctgtgaggggcacctgtgtgggaggaagcacagctcgggttcccacacctcacttttcacagcctctgagggcagcagtgcacgtggaggagacgtctcccatgaggccaaggcctccagtgctcaccgatgccctctgcgaagttggggtagaactcgtcagtgaagaggggctcgggcagctcacggaagtacagcttcagcatgcctgcgatggcgttcacgtccatctcgctcatcatcactgacacgtccttgttatctggaaagagcacggaaatgcagcggcctccttgaagatcctgataaatgaagaaaagacacagagaaggatgtgacatgcctgggccatggagcactctgagatctcatcgtggacaccactgcccacacctccatcccgtcctgcgcaggccgacactcactgacgttgaagcctgccttcagtgcctggatgtctgcggccaccccagacatgcggtagatgcccacctcctccatgcctcggcgctcgatctcctccacgcactgacgcacgatgtagggcaccttggacctctctctcctgcgggaggagggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcctcattgcatgtactttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaatccctgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggcttatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgtatgaactgctctcaaaccaacaaataggcttctcttggcaactgactcgtgacaaagggttcaagattgtttgaaaaaaaaaaaaaagggggggaacagggaggcagtaggtcctggaaaagtaaattctttattttacaataagaaagtgattacatattttattttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgaga

SEQ ID NO: 731169 - DNA, 909 bp, Homo sapiens
  misc_feature (4)..(4): n is a, c, g, or t
  misc_feature (8)..(8): n is a, c, g, or t
  misc_feature (11)..(11): n is a, c, g, or t
  misc_feature (35)..(35): n is a, c, g, or t
ttantctnttntaggaccgccgccggttcggaatncccgggtgcgacccacgcgtccggctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggcttatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgtatgaactgctctcaaaccaacaaataggcttctcttggcaactgactcgtgacaaagggttcaagattgtttgaaaaaaaaaaaaaagggggggaacagggaggcagtaggtcctggaaaagtaaattctttattttacaataagaaagtgattacatattttattttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgaga

SEQ ID NO: 731170 - DNA, 562 bp, Homo sapiens
cactcataggtgggaactgaacaatgagaacacttggacacaggaaggggaacatcacacaccagggcctgttgtggggtgggaagagtggggaagcaaatgaattctcagaggaagtggtctgtgtctgtatgaactgctctcaaaccaacaaataggcttctcttggcaactgactcgtgacaaagggttcaagattgtttgaaaaaaaaaaaaaagggggggaacagggaggcagtaggtcctggaaaagtaaattctttattttacaataagaaagtgattacatattttattttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgaga

SEQ ID NO: 731171 - DNA, 426 bp, Homo sapiens
ggttttcatacataaagatcttttgagacattgaggatgagttgactgattaaaattttaaaagatctaatgtttcaaaagaatttgggatcttattaaaaggatcttgaattctttcacattcaaacctagatcagtttgagagggggaaaaaacctggtaatctatgtagtcccctcatactaacttggagctgaataacacttatacttgctggtataaatgccttgtgatacagaaggtagataaagcaggaaataataactgttaaaatactatctaagacaggaagcatcatttgtatttcttgacagtttaaatgcttttttctctcatgaatctagtagctgagaaagtaatagaaattgcttggaaaaaaataatgttggccgccaggtgcagtggctcatgcctgtaatcccagca

SEQ ID NO: 731172 - DNA, 723 bp, Homo sapiens
agcggatcacctcctaggaaatatgcagtaagatggattgtgtgcctgaaggttaaactctttttccaacaggtattcaatggcattagaagtaactcaccccagctagagaaactgtgtagtagtgtgaatgtaagcaatgagattaaatcttcaggaaacacaatgaaagtcatttttttcacggatggatccaggccatatggcggcttcactgcttcctatacctccagtgaagatgcagtgtgtggtgggtctcttccaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgatgctgatgggcccctgatgtggagactttgtggtccttcaaagcctacattgccattggttataccttattctcaggtatggattcactttgtcaccaacgaacgtgtagaacacattggattccatgcaaagtattcctttacagattgtggcggaatacagataggtgacagtggagtgatcacaagccccaactatccaaatgcttatgacagcctgacccactgctcttggctgttggaggccccacaagggcacaccatcact

SEQ ID NO: 731173 - DNA, 1184 bp, Homo sapiens
gcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagcgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagaaatccttgctctaacatccccaaggaaccggaagaaggctcccgtgattggcacagagagtaagcatggcctggtgcaaaaggagctgaagacttaggaagagccggagcattgaaggggagccactgaatggccttaagtagaaaaggggacaccccaccacaccagtgtccccagctgtactctttccatgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctcctgctcagctcaggcatcactttctgcaggaaactttcccttccctttttaagcagagtgaggcatctcagggcctctatgttcccatcatgctctagggatatccatcgtcaaagctttgctgatgacacacacattgtctttctaaaaacgaagtccaaaaaattaaggcagatcaatgccaaacttacttttgtacagttctttgaagtcaccttttaaactagacagtgtctttccttatagtttggctggtctcttttattttgtgatttttaaaagattaataaataaattctgctatagaatgaacaaatcctttcaa

SEQ ID NO: 731174 - DNA, 11915 bp, Homo sapiens
  misc_feature (11914)..(11915): n is a, c, g, or t
ctcttacctgccaacctgggaggttgatgatgaacatgtctttaccttttctttggagtttgcttaccttattaatatttgctgaagtaaatggcgaacgtggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagcgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagttgtcactgcccacctgagacgtacggaccccagtgtgcatccaaatatgacgactgtgaagggggttctgtggcacgctgtgtccatggcatctgtgaggatttaatgcgagagcaagctggagagcccaagtacagctgcgtctgtgatgctgggtggatgtcttcacccaacagccctgcctgcacgctggacagagacgagtgcagcttccagcccgggccttgctccacacttgtgcagtgtttcaacactcaaggctctttctactgtggggcctgtccaacaggctggcaaggcaatggatatatttgcgaagatatcaatgaatgtgagataaataatggcggctgttctgtggctccacccgttgagtgtgtgaatacacctgggtcttcccactgccaggcctgtccaccagggtaccagggtgacggaagagtgtgcacactcacagacatctgctcagtcagtaatggaggctgccacccagatgcctcatgctcctcaactctaggttccttacctctctgcacgtgtctcccgggttatactggaaatggttatgggccaaatggatgtgtgcagctcagtaatatttgcctaagtcacccctgtctaaatggacaatgcatcgacactgtctctggttatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaagtttgtggagagtccctctcaggaataaatggaagcttcagctacaggagcccggatgttggttatgttcatgatgttaactgcttctgggttatcaaaactgaaatgggaaaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcgcttgcggggatgaattaactggagaaggggtcattcgctcgcctttttttcctaacgtgtatcctggagaaagaacctgtaggtggaccatccaccagccccaaagccaagtcattctcctcaacttcactgtctttgaaattggaagttctgcccactgtgaaacagattatgttgagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttggcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaagatactgtggaaagtcgatcccgccatctctcacaagcagtggtaactcattgatgctggtgtttgtgactgactccgacctcgcttatgaaggcttcttaataaactatgaagcaatcagtgcagcaacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcagagatggaggctatgaaaaatcaccattgctgggaatattctatggctcaaatctacccccaacaatcatctctcatagtaacaaactatggttaaaatttaagagtgaccaaatagacacaaggtctggattctcagcttactgggatgggtcatcaacaggttgcgggggtaatctcaccacttcaagcggtacgttcatatctcccaactacccgatgccctattaccacagctctgaatgctactggtggttgaaatctagccacggcagcgcatttgaactggaattcaaagactttcacttggagcatcatccaaactgcactttagattacctggctgtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagacatgtgagaatgtggtaatagtcaatcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacggttgtggtggagagctgtctggggccacaggctccttcagcagccccgggttccccaacaggtatccaccaaacaaggagtgtatctggtacattaggacggaccccgggagtagcattcagctcaccatccatgacttcgatgtggagtatcattcaaggtgcaactttgatgtcttggagatctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggttgtggtgggattttccaggctcccagtggagagattcattctccaaattaccccagtccttataggagcaacacagactgttcttgggtcattcgggttgacagatatcatcgtgttctcttgaacttcactgactttgatcttgaaccacaagactcttgtattatggcatacgatggcttaagctccacaatgtcccgccttgccaggacgtgtggaagggagcagctggctaaccccatcgtctcctcaggaaacagcctcttcttgagatttcagtctggcccttccagacagaacagaggcttccgagctcaattcaggcaagcctgcggaggccacatcctcaccagctcatttgatactgtttcctctccacggttccctgccaattatccaaacaatcagaactgcagctggatcattcaagcgcaacctccattaaatcatatcaccctctcttttacccactttgaacttgaaagaagcacaacgtgtgcacgtgactttgtagaaattttggatggcggccacgaagacgcgcccctccgaggccgttactgtggcaccgacatgccccatcctatcacatccttcagcagcgccctgacgctgagattcgtctctgattctagcatcagtgctgggggtttccacaccacggtcaccgcatcagtgtcggcttgtggtggaacgttctacatggctgaaggcatcttcaacagccctggctacccagacatttatccccctaatgtggaatgtgtctggaacatcatcagttcccctggcaaccggctccagctgtcttttatatctttccagttggaagactctcaggactgcagcagagattttgtggagatccgtgaaggaaatgccacgggtcacttggtgggacgatactgtggaaactccttccctctcaattattcttccatcgttggacataccctgtgggtcagatttatctcagatggttctggcagcggcacgggcttccaggccacatttatgaagatatttggcaatgataatattgtgggaactcatgggaaagtcgcctctcctttctggcctgaaaactacccacataactccaattaccaatggacagtaaatgtgaatgcatctcacgttgtccatggtagaatcttggagatggacatagaagaaatacaaaactgctattatgacaaattaaggatctatgatgggcctagcattcacgcccgcctaattggagcttactgtggtacccagactgaatctttcagctccactggaaattctttgacatttcatttttactccgactcttcaatctcggggaagggattccttctggagtggtttgcagtggatgcacctgatggtgttttacctaccattgctccaggtgcttgtggtggcttcctgaggacgggagatgcacccgtgtttctcttctccccgggctggcctgacagttacagtaatagagtggactgtacgtggctcatccaggctcccgactctaccgtggaactcaacattctttccctggacattgaatctcaccgaacgtgtgcctatgatagccttgtgatacgagatggagataataacttggcccagcagctagcagttctctgtggcagagagatccctgggcccatccggtctactggagagtacatgttcatccgcttcacctcggactccagtgtaaccagggcaggcttcaatgcatcctttcacaagagctgcggtggatatttgcatgcagacagagggatcatcacgtcccccaagtatccagagacttacccatccaacctcaactgttcttggcacgtcctggtccaaagtggcctgaccattgctgtccattttgaacagcctttccagattccaaatggagattcttcttgcaaccagggggattacttggtgctaagaaatggtcctgatatctattctccacccttgggaccccctggaggaaatggtcatttttgtggcagtcatgcttcatcaactctgttcacctcggataatcaaatgtttgttcagtttatttctgatcacagtaatgaagggcaaggatttaaaatcaaatatgaggcaaagagtttagcctgtgggggcaacgtctacatccatgatgctgattctgctgggtatgtgacctcccccaaccaccctcataattatcccccgcacgctgattgcatttggatcttagcggctccaccggaaacacgcatacagctgcaatttgaagatcgattcgatattgaagtaacacccaactgtacttccaactaccttgagttgcgggatggagtggattcggatgcaccaatactttccaaattttgtgggacatctttgcccagcagtcagtggtcctcaggagaggttatgtatttgagatttcgatctgacaacagccccacacatgtgggattcaaggccaagtattctatagctcagtgtgggggaagagtaccagggcaaagtggtgttgttgaaagcattggacatccaacacttccatacagagacaacttattctgtgagtggcatctccaggggctctctggacactatctcaccatctcttttgaagactttaaccttcagaattcttctggctgtgaaaaagacttcgtggagatctgggacaatcatacctctggaaacatcttgggcagatactgtggaaacaccattcctgacagcatagacacttctagcaatactgctgtggtcaggtttgtcacagacggctctgtgactgcctcaggattcagactgcgatttgaatccagtatggaagagtgtggtggggatcttcagggctctattggaacatttacttctcccaactacccgaacccaaatcctcatggccggatctgcgagtggagaatcactgccccggagggaaggcggatcaccctaatgtttaacaacctgaggctggccacgcatccgtcctgcaacaatgagcatgtgatagtattcaatggcattagaagtaactcaccccagctagagaaactgtgtagtagtgtgaatgtaagcaatgagattaaatcttcaggaaacacaatgaaagtcatttttttcacggatggatccaggccatatggcggcttcactgcttcctatacctccagtgaagatgcagtgtgtggtgggtctcttccaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgatgctgatgggcccctgatgtggagactttgtggtccttcaaagcctacattgccattggttataccttattctcaggtatggattcactttgtcaccaacgaacgtgtagaacacattggattccatgcaaagtattcctttacagattgtggcggaatacagataggtgacagtggagtgatcacaagccccaactatccaaatgcttatgacagcctgacccactgctcttggctgttggaggccccacaagggcacaccatcactctcacatttagtgactttgatattgaaccccatacaacttgtgcttgggactctgtcactgtcaggaatggtgggtcccctgaatcacccatcataggacaatactgtggaaattcaaaccccaggacaatacagtcaggttccaatcagctggtcgtgacttttaactcagaccattcattgcaaggtggtggattttatgctacgtggaacacacaaactttaggttgtggtggaatatttcattctgataatggtacaatcagatcccctcactggcctcagaattttcccgaaaacagcagatgttcctggacggccattactcacaaaagtaaacacttggagatcagctttgacaacaacttcctaatccccagcggtgatggacaatgtcagaatagcttcgtgaaggtgtgggcaggaactgaggaggtggacaaagccctgctagccactggctgtgggaacgtggctccgggtcccgttatcacaccaagtaacacattcactgccgtcttccagtctcaggaggcaccagctcagggcttctccgcgtcctttgttagccgatgtggaagtaatttcactggcccttcaggttacatcatttctccaaattacccaaaacaatatgacaacaacatgaattgcacctatgtcatagaggctaatcctctgtcagtggtcctcttgacttttgtgtccttccacttagaagctcgttccgctgtgacgggaagctgtgtcaacgatggcgtgcacattatcagaggttacagcgtcatgtccaccccatttgctactgtgtgtggggatgagatgccagctcccctcaccatcgctgggccggttctgcttaacttctactccaacgagcaaatcacagacttcggattcaagttttcctataggataatctcctgtggtggtgtgttcaatttctcttctggaatcatcacaagtcctgcctattcatacgcagactacccaaatgatatgcactgtctgtataccatcaccgttagtgacgacaaggtgatcgagctcaagttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagcaaaaggctggaagatgtctttccggcagacattggggcctcagcaaggatgtggtggttatctgacaggctcgaataatacctttgcctctcctgattctgattcgaatggaatgtatgacaagaatttaaactgtgtatggatcataattgcacctgtaaacaaagtaattcacctcaccttcaatacatttgctctggaggcagcaagtactaggcaaagatgcctttatgattatgtaaagttatatgatggggatagtgaaaatgcgaacttggctggaacgttttgtggttccacagtacctgctccttttatctcttctggtaacttccttacggttcaattcatcagtgacttaacattagagagggaaggatttaatgctacatacaccatcatggacatgccttgtggtggaacgtacaatgcaacttggaccccacaaaatatttcatcacccaattcatcagacccagatgtcccattttccatctgtacttgggtcattgattcccctccgcatcagcaggtcaagataactgtgtgggcattacagctgacctcgcaagactgcacgcagaattacttacagcttcaggactcaccgcagggtcacggaaattcaagatttcagttctgtggcagaaatgcttcggctgtgccagtgttttattcttctatgagtactgcaatggtcattttcaaatctggagttgtaaacagaaactctagaatgagtttcacctatcagattgcagattgcaacagagactatcacaaggcatttggcaacctgagaagccctggatggccagataactacgacaatgacaaggattgcaccgttactctcacagccccccagaaccacaccatttccctcttttttcattcacttggcatcgagaactcagttgaatgcagaaacgatttcttggaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggatgtggtggaactctttatggagacagaggctcattcaccagccccggctatccaggcacatacccaaacaacacgtactgcgagtgggtccttgttgctcctgctggaaggcttgtcaccatcaacttctacttcatcagcattgacgatccaggagactgtgtccagaactatctcacactctatgatgggcccaacgccagctctccatcctctggaccatactgcggaggcgacaccagcatagctcccttcgtggcttcctcaaatcaggtcttcataaaatttcatgctgattatgcacggcgtccatccgcattccgattaacttgggacagctaagtgggtaacaactcgtgttcactcagcactttccctctgcagcacgctggacagcactctgccatcctgatacatgacccctgctgatgccacagagaataagctgaacttgtatggtttttcaccaaaccatggatagaatcaatatttgtaggccaggcgtggtggctcacccccctgtattctcagcactttgggaggccgaggcaggttgatcacctgaggtcaggagtttgagactagcctggccagcatggtgaaacctcatccctctaacaatataataattagccaggcgtggtggtgggtgcctgtaattccagccactcgagaagctgaggcaggagaattgcttgaacccaggaggcagaggttgcagtgagctaagatcacaccactacactccagcctgggcgagacggcaagactccatctcaaaaaaaaaagaaacaaaaaaaaccagaatcaatatttgtacattttctcgaacatagaatatagcttctttagtcttgagtgtgcatttcattctaatattttgagctgaaatttaaaaaaactttgaaagagttggaaatgattatggcatatgtgacatacatttttaaaagttaataataatagccaggggcagtggctcatacccataatcccagcacgctgggaggccatgatgggaggattgcttgaacctaggagtttgagaccagcctgggcaacaaagtgagacctgatttttacaaaaaatcaaaaaattagccaggcatggtggcatgcacccgtggttccagctacacaggaggttgaagcaggaggatcacttgagcccagtaggttaaggctgcagtgaaaccctgtgaattaaccactgtactccagcctgggtgacagactgagaccctatctcaaaaatgacaacaagaacaacaaaagttaatgataatatagaagcataaatttcctgtgaatgttcaattacacataataaacattattgaattgtacacaaaaaaaann

SEQ ID NO: 731175 - DNA, 683 bp, Homo sapiens
atctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggttgtggtgggattttccaggctcccagtggagagattcattctccaaattaccccagtccttataggagcaacacagactgttcttgggtcattcgggttgacagatatcatcgtgttctcttgaacttcactgactttgatcttgaaccacaagactcttgtattatggtttaatcatacttggtcggacgtcagacagatggggtttgtatattggctctgcactgctaagcgtgtgattgggcaagtcatgtatgttttcagagctcagttttccctgctgcaaagtggaactgtaagaatcaaatgtaaacaaatgtatttaagtacctatcagtgtctggttcagataagtatttgctgctattcctaatttttctattacaatgactcctgcttctattactattaacgctatgttaaagatcttaaggaatcttttaaaaaaattttctccctgagcaagatgaaacttagtaaacaagataaaaaatccagtagaaaaa

SEQ ID NO: 731176 - DNA, 335 bp, Homo sapiens; identical to SEQ ID NO: 10568

SEQ ID NO: 731177 - DNA, 695 bp, Homo sapiens
tcttctatgagtactgcaatggtcattttcaaatctggagttgtaaacagaaactctagaatgagtttcacctatcagattgcaggtgaggccaggaacttcatcttttattcaaaaaagctgccatcattaccattattcgtagaataattacaattatttctagaattgactcctgtgagtaaattaggatttgttaacaaaaaccacatccctctcttaactagaacccagcccaatttagcaaattactacagttggtttctaaagagataaagagaatataatactatccaggatggttagaatgctagcattttcttcaaagtatatgtagttgattttaaaaatatgccaattatcttattaattatacacttaaccacattgaatatacatttttatttacaagaaatatatatgtttatttacaaaagctttatcaaaatataattctcatatcatacaatttacccatttaaagtttatatttcagaggtttttagtattttcacaaaattgaaaatcttagaaaattattttgtaaaaatcaaaaagccttgaaagagttacctgattattataagaagtttattttcacagaacactttatttagtacttattttgaattgactcaaatgaaagcttcctttggttaaaacaaacgaaagtacttttggtatttttttaccaa

SEQ ID NO: 731178 - DNA, 406 bp, Homo sapiens
tgcagacataatgatggcaggagctggagcagccacctgaggacccagagctcaaagccacatgttgagaagggcagagataactgtatccactctggactgctgacctttgaactattatgttatttccagggaaatgcaaaccaaaggatgtggtctctgatctaatccttagagaatgtgaccatgaagacacttttcctacctggtaaacaaaagataatgagaaaagtgaggttggaagttggtttactgagccaggagctataacaggtgctggagcaggggtgtgatctgaatgaccagagggaaggactgatggaattggatggtgagagcctccaggccctttaggcttctccctgactttataatgaaatacaaaagtcagcctccaaaaaaatcc

SEQ ID NO: 731179 - DNA, 716 bp, Homo sapiens; identical to SEQ ID NO: 337898

SEQ ID NO: 731180 - DNA, 1745 bp, Homo sapiens; identical to SEQ ID NO: 337896

SEQ ID NO: 731181 - DNA, 393 bp, Homo sapiens
tgcagacataatgatggcaggagctggagcagccacctgaggacccagagctcaaagccacatgttgagaagggcagagataactgtatccactctggactgctgacctttgaactattatgttatttccagggaaatgcaaaccaaaggatgtggtctctgatctaatccttagagaatgtgaccatgaagacacttttcctacctggtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcctgaagag

SEQ ID NO: 731182 - DNA, 616 bp, Homo sapiens
tttgagacggagtgtcactctgtcgcccaggctggagtgcagtggcgcaatctcagctcactgcaagctctgcctcctgggttcacgccattcttctgcctcagcctcccgagtagttgggactacaggcgcccaccaccacgcctggctaattttttatatttttagtagagatggggttttactatgttagccaggatggtctcgatctcctgaccttgtgatccacccgccttggcctcccaaagtgaaacttttctttaaaatagagatgggatcttgctgtattgcccagactggtctcagactccttgccttaagcagtcctcccacctcagcctcctaaagtgctgggattacaagcgtgaagcattacatccaagtgaaacttcttgagatagttacataatgtttaaatctgctggtgtacaagttaataaagtgtagaactgaataaatattaaatattagatcaagtttctcatgtttaccttaacgtataaagatttatcttaaagcactgattttcacaaaataacatcagtgtgaaattggaaaagaagccaaatattttatttcatgtatcggggaaatgaggtgctttagtcaactgaat

SEQ ID NO: 731183 - DNA, 872 bp, Homo sapiens
tacttttgtcaggtttaagccgttttttccataccagaccttgcaaggatttgaagaagatgaagagcatatccatatacaacaatgggcacttactgaaggccgtcttaaagttacgttgttagaatgtagcaggttactcatttttggatcctatgacagagaggcaaatgttcattgcacacttgagttaagcagtagtgtttgggaagaaaaacagaggagttctattaagacggttgaattaatggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtggtgtgaaaatcacatcaacactgcaagtgttgaagcttatcaagcaggctggtgactggtcctggtgtactatgggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggaggctatatcaccagttttaaaccggtaaattagctgtaggaagtcacccactaccaccgaaaattcagtccaaagatggaaataaacctccacccctaaaaacttctgagataacagacccagcacaagtgt

SEQ ID NO: 731184 - DNA, 1108 bp, Homo sapiens
tgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtgcacgaggctgatcgacttcgaggtgcgctcgcagtttgaagggcggcccatgccccagctcacctccatcatcgtcaaccagctcaagaagatcatcaagcgcaagcacaccctaccgaattacaagatcaggttgaattaatggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtgtggtcctggtgtactatgggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggaggctatatcaccagttttaaaccggtaaattagctgtaggaagtcacccactaccaccgaaaattcagtccaaagatggaaataaacctccacccctaaaaacttctgagataacagacccagcacaagtgt

SEQ ID NO: 731185 - DNA, 746 bp, Homo sapiens
tgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtgcacgaggctgatcgacttcgaggtgcgctcgcagtttgaagggcggcccatgccccagctcacctccatcatcgtcaaccagctcaagaagatcatcaagcgcaagcacaccctaccgaattacaagatcaggttgaattaatggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtgtggtcctggtgtactatgggcctgttggccagagtaatcaaggtgcagtgctgc

SEQ ID NO: 731186 - DNA, 745 bp, Homo sapiens
ctcgatcccccgaccttgtgatccacccgccttggcctcccaaagtgttgggattacaggtgtgagccaccgtgcctggcctgaaggtcatttttataaagatctctccacgtcttagatttgattcttcctttaaatatttttctcattgacatttgaaagcacctgaccttatataaaatgaacaattttcataactccataaaaggagaattatggcatcatctatttctttctcttgtctcataaatctaaaccatcaacctgcttatttttgtatactgtcacactgtgtattccctgcattgaatgcctgtctgttgacattgtctgtaaaaattgtgggaagttttctgcaccctgaaatttctgttatgcggattaaatatccactatccatgtttttccaagtcttacagtagaaaggggtaaatgcagcccgtcacagcagcctgttgttcgtcctgcaaatgtgtttccatcacattacacaaagcctctttgtcttcgtggttctaccctactaataagtttttaaaaaaattatgtaatgtgtgtatatacaaatacctatatgtatgtgtgtacacatacagctgatatctgctgagattatgtatgcatgaactatagaattaacttgtaattttaagaaaataaattattttgtaaagataaatctcatgtttaagaagaggaattacagttgaatcatttagggatgcctcagcctaaacataatatg

SEQ ID NO: 731187 - DNA, 678 bp, Homo sapiens
agaaaaagagcaagaaacttgaaagtagggaagagaaaaaagaaaaggagcaagagggaatagccagctctcaaaagagtctccaataggaaagcaaaatctgtatctagccagtaccaacatgtgaagaaagagtgagcatagcaaaattgagaaaggttgcttgaaaaccaaacaaaaaaccaaatacctgtaatcctagcactttgggagggtgaggtgggtggattgcctgcactcaggagttcaagaccagctgggcaacatggtgaaaccttgtctctactaaaatccaaaaaaaaaaaaaaaaaaaaaaaaaaattagccaggcatgggctgggcgcgtgttttccaggctggtctcaaattcctgggcttaagtgatcctcccacttcagccttacagtgttgggattacagtcacgagccactgtacccaaccatatgtcattctttagacacactgcttactaaatttctctttttaaaggatatactgaatttccggttgagccaacttaacagctaattttctattttagctttaaaacattgataagcaacatgaagcaatctagaacttaacctttaagtggctttattaaagcaatccagctatgaaaattatgcagaaatgattatctacaatcttaccagcacataagaaattcttcctct

SEQ ID NO: 731188 - DNA, 448 bp, Homo sapiens
cctacacctgggagcagtatctgccactgggataaagtcctactaaaaaaggaacggtaaatgtaccctaatgattaaaccccgtgagatacatatgatttcccaaatagtccatttcattaggaacttttttgtttgaatgaatgtcacataggtatcctcagtaacacagaacgaaattacctttgtattattgtgattagttgttgcttattattttatactcagtaataatgtggtacactgttaatttttttgcttttgtaaattatattctaatttattgccatgtttcctaacacttgtcctacattcattctcctgcttgtaatgaaaatgaaaaaatcattgtaacacttgatggagtgaaattccacgccaggcacagaatttttttgacatagataatttagtaaaataaaaattcagcttataataatgatacaga

SEQ ID NO: 731189 - DNA, 790 bp, Homo sapiens; identical to SEQ ID NO: 118441

SEQ ID NO: 731190 - DNA, 876 bp, Homo sapiens
cgatatttgtggttctggctccagggcctgcccgcgcacacactggggcaccgtcgccagctcagaatccgcttcagtgtctgcacgatcagcagcaccgacacacaacccgtggctttacagagcaataacacaaccgggtgtgacaccccgcgacgtggacacacaaacacaatctcgtgccctcatgtacgagtgtcacagccacagttcactagatgaaccctcaaaacctagccaccccccacattcctttaaggaacacaccctagcatatatcatcttacccacttctggctggaaagcagtgatgcaattatagctaactgcagcacgagccactgcactggctaagttcatacacacacacgtgtgtgtgtgtgtgtgtgtgtgagattctgtggctcaggctggagtgcagtgacacaattatagctcactgcagcatgagccactgcactggctaagttcgtgtgtgtgcgcgcatgtgtgtgtgtgtgtgtgtgtcattctgtggctcaggttggagtgcagtgatgcaattatagctcatggcagcacgagccactgcactaagttcatacacgtgtgtacgtgtgtgtgtgtttgtgtcattctgtggctcaggctggagtgcagtgatgcaattatagctcactgcagcctgcaactcctggacccaagtgattttttacctcagcctcccaagtagccaggactacaaatgtcaaagtgtgggactacaggcatgagccctatacccagcctaatttcacacccttttaagcctgttaaaacatcatgtgacattctaaaatttttcaaatataagcaacttattttctttaagtggagaatcataaatgctcagattaa

SEQ ID NO: 731191 - DNA, 655 bp, Homo sapiens
ggaagaaattaacgcatgattttttgagggggaaaacatgatttttctctaaagggaaacgtgtcgtagccttaaccaagatcaattacctccatgttggtcgcagccttaaccaagatcagtcacctccatgttggttgatcttggttaaggctacaacaggcttgaaggggtctggagggtggctttactggctaggggcagcaccagccagatcagacctataggggatctaggcctcttgtactccataccctgtcttctcttccccatttgccatttgacttggggactccagaagcccttgaggagaggcagcatggagggtaaaagaggggaggaggtcccaggccaaaggagatgccatttctcccctccaaacccacccacagccctctggagagaaatgagagaattacttgttaacatttacatggccatcttaacatttgcaaggaaatactgaggtccagggggacagtaatctgcccgaaatcactcagtcttcctgagtgagagccagacagaaatccaagcctaccgactcccagtctcatactcgggaaatggctggatctgccagccagtaagcagacctcagccctgtaggaaaggtggcctagatttcatgaaagaatggacaataaaaaaaaaa

SEQ ID NO: 731192 - DNA, 441 bp, Homo sapiens
tggcttgagtttttcaaaacaatcaatcctggtttggggaagtttaaatatggcctgtatatgataccattgaattacttgctcatgtactcaggtgcaagtttggtattgtggttctgcgggagaatgtccttattcttaggagttgcaagctgaagaatttaggggtgaggtgctgctatctgcaactgccatccaaaaggttcagaaaaaatgttctatgtatgtatctctttaaatagagaaaaagaaagaaaggccaaactttaacaactggcaaatcttgctgaagggttcatggatatttattgtgctctttttttcaactttctgtagattagaacatttcccaaataaaaacatgaaaaaacaacttttaatagaatagacatttacatcctctccccattcaaaatttgggaaaaaaatcagtgaaagtgg

SEQ ID NO: 731193 - DNA, 581 bp, Homo sapiens; identical to SEQ ID NO: 70268
  misc_feature (575)..(575): n is a, c, g, or t
  misc_feature (577)..(578): n is a, c, g, or t

SEQ ID NO: 731194 - DNA, 2136 bp, Homo sapiens
tacttactagataagccaaaagacctgtttgttacacaaacatgcatgcatccaggtattaatccattctcacactgctatgaagaaatacccgagactgggtaattataaaagaggtttaattttcgactcacagttccacatggctgggaaggcctcaggaaacttaacaatcacggtggaaggcacctcttcacagggcggcaagagtgagaatgagagccagtaggggaaatgccaggcacttataaaaccatcagatctcatgaaagctcactatcatgagaatagcatgagggaaactgcccccatgattcaattacctaccacaacacctgggaattatgaggattaaaattcaagatgagacttgggtggggatacatccaaaccatatcaatccatatatggctgaaatttacatcagacaatggtaaatatctatgttcaaagtccattgatgctttgagattctgagctattttctggtatggaaaacagacttagcatctccatctccattggatgtatgctgcctcctgtgatgatcaaggaatgcaatggttctcccaagtccacagtgcacatttgccttaaagtgcctgctgcaattttctggtcgtcggctccaaccctggctaagccaacacaaagtgtctcctcggtaactgctattaaaaaaaaaagatactgctattcaattcagcaagtgcatcatccatccaacagtcaaacaaacattagtaccacaagtacatttcaagaagccccaaatatcttaaatctcttttgccacttatggaccagttatccattaattcatccaagggattttctaaatcatttgtattacctaatataaaagagtacttccaaactttaccctttcagaattacaaaggcttacactaagcttttaggacttgacaagctatacttacactctacaattgcacagcattcgtttttaaataagttctgagtaaacaatgtttattacacacaggtttttaataacttgcttgagataatgttcatattgacctagatatactgaagaaaccatgagattatgaaataaattcacagatttgagtttctgccttgccatccaattagctgtgtgataaacttcagttttctcattttttaaaatgtaatactccctcttttaaatcatggtaatgagagctaagatagtagatatgagactagtagactatagattccttaacaaataatgagcatttggcactatttatgtttttcagttaaaaacagccagccttagctttagtattattcactctggtgctacagctaaagagctgaccctttaatggttgtattgtttagttgggaaaggggtcttgattgaacaatgatcaaaagggggcaaatggtttatccaaggacaaacaggaatgcaggaaacttctgtacaaagttatggatatagaacatccttgcagactatttgtttcacgactttaacatggcctactaatgagaataaaataagcaacaatcactcaagaatctcttgactgggtgcggtgactcgcacctgtaatcccagcattttgggaggctgaggcaggcggatcgcttgagctcaggagtttgagaccagctgggcaacatggtgaaaccccatctccaccaaaaatacaaaaaaattagctgggtgtggtggcatgcacctgtagtcccagctactcaagtggctaaggtgagagggtggcttgagcccgggaggcagaggttgcagtgagccatgattgcaccactgcactctaacttgggcaacaaagcaagaccccatctcaaaaaaaaaaaaaagtctcacagtgggccaggcgtggtggttcacacctgtaatcccaacactttgggaggctttgggaggctgaggtgggaggattgcttgagccaaggaattcgagaaaagcctgggcaacatggtgaaaccctgtctctaccaaaaacacacaaagaaattagctgggcatggtggcatgcacttgtagttcagctaaggtgggaggatcacttgagcccaggaggtggaggctgcaatgagctgagatagtgcctctgcactccagcctgcgtgacaaagtgagaccctctctc

SEQ ID NO: 731195 - DNA, 485 bp, Homo sapiens
ggctctcacacacacgtgcgtgattggttagttcgcctgtgcatatacccacctatgcccacagggaggtgtttgggggacacatgtcagagacgggcaccaacagctggcagctgacttggcatgggagtttctgacagtggtggagtcccacaataatggcttttagcttaccacatcctgtgcctcagtttacccctcttgtataatagagagagcttggagagactgaggacacaggagacacaggtggttgagtgttctgagatctgcagactgggaggcattatgcctgtaaaatgtaaagttaacaaaggcagaaactggtggtgggaagtggaggaggtccttaaaaagaaagatgggactgggcctggttgtcacgcctgtaatcccagcgcttggggaggctgagacagaaggatcacttgagcccagaaatttgagttcaccctcagcaacataatgagaaccctgtctctgca

SEQ ID NO: 731196 - DNA, 722 bp, Homo sapiens
tgcatgcatgggacaggatgctttcatggagcccttcggtgacacacttggggtctttcagtgcaaaatatacctccttctcttcggtgcttgctcggggctgaaggtgacagtgccatcacacactgtccatggcgtcagaggtcaggccctctacctacccgtccactatggcttccacactccagcatcagacatccagatcatatggctatttgagagaccccacacaatgcccaaatacttactgggctctgtgaataagtctgtggttcctgacttggaataccaacacaagttcaccatgatgccacccaatgcatctctgcttatcaacccactgcagttccctgatgaaggcaattacatcgtgaaggtcaacattcagggaaatggaactctatctgccagtcagaagatacaagtcacggttgatgatcctgtcacaaagccagtggtgcagattcatcctccctctggggctgtggagtatgtggggaacatgaccctgacatgccatgtggaagggggcactcggctagcttaccaatggctaaaaaatgggagacctgtccacaccagctccacctactccttttctccccaaaacaatacccttcatattgctccagtaaccaaggaagacattgggaattacagctgcctggtgaggaaccctgtcagtgaaatggaaagtgatatcattatgcccatcatatatt

SEQ ID NO: 731197 - DNA, 780 bp, Homo sapiens
gtaaccagtactagaatagtcagtacctagaagccactcttctttgaaaaggattatcacctgatcaggttctctctgcatttgcccctttagattgtgaaatgtggctcaaggtcttcacaactttcctttcctttgcaacaggtgcttgctcggggctgaaggtgacagtgccatcacacactgtccatggcgtcagaggtcaggccctctacctacccgtccactatggcttccacactccagcatcagacatccagatcatatggctatttgagagaccccacacaatgcccaaatacttactgggctctgtgaataagtctgtggttcctgacttggaataccaacacaagttcaccatgatgccacccaatgcatctctgcttatcaacccactgcagttccctgatgaaggcaattacatcgtgaaggtcaacattcagggaaatggaactctatctgccagtcagaagatacaagtcacggttgatgatcctgtcacaaagccagtggtgcagattcatcctccctctggggctgtggagtatgtggggaacatgaccctgacatgccatgtggaagggggcactcggctagcttaccaatggctaaaaaatgggagacctgtccacaccagctccacctactccttttctccccaaaacaatacccttcatattgctccagtaaccaaggaagacattgggaattacagctgcctggtgaggaaccctgtcagtgaaatggaaagtgatatcattatgcccatcatatatt

SEQ ID NO: 731198 - DNA, 594 bp, Homo sapiens
ttatttgtgtcttcctccattacattataattttgacttcctgtaattcacctttgattcttcagcacttaatagtctgcctggcactaagtgctcaataaattctgaactcaaatcactaacagcaaaagaattatttatgcattccccttaattgtgtgcctaacacgtttaactgccttattttatttttttacaaacagggtctcactttgtcacccaccctgaggtgcagtggtgtaactatggctcactgcagcctcaacctcccaggctcggatgatcctcctgcctcagcctcccaagtagctaggacaacaggtgcacgccaccatgcccagctaatttttgtattttttgtagagatggggtttcactatatttcccaggctggtcttgaactctgggctcaagcgatcctcctgcctcagcctccctaagtgctgggattacaggtgtgggccaccgcacctgacctgccttattttttttaaatcaaatagtagaacaacattaaaagaaatataattatctaatctctaatagcatatatgttcatatttgcatactctttcagtcaataacgttttatat

SEQ ID NO: 731199 - DNA, 491 bp, Homo sapiens
cagatatataggatgaaatttctcattacattatttatgcattccccttaattgtgtgcctaacacgtttaactgccttattttatttttttacaaacagggtctcactttgtcacccaccctgaggtgcagtggtgtaactatggctcactgcagcctcaacctcccaggctcggatgatcctcctgcctcagcctcccaagtagctaggacaacaggtgcacgccaccatgcccagctaatttttgtattttttgtagagatggggtttcactatatttcccaggctggtcttgaactctgggctcaagcgatcctcctgcctcagcctccctaagtgctgggattacaggtgtgggccaccgcacctgacctgccttattttttttaaatcaaatagtagaacaacattaaaagaaatataattatctaatctctaatagcatatatgttcatatttgcatactctttcagtcaataacgttttatat

SEQ ID NO: 731200 - DNA, 427 bp, Homo sapiens
tcctgggctcaagcgatccccctacctcagcctcccaaagtgctgggattacaagcatgagccaccacactcagccttcaaaggtatttatcatctatgtccattatactatataatagttatttgtgtcttcctccattacattataattttgacttcctgtaattcacctttgattcttcagcacttaatagtctgcctggcactaagtgctcaataaattctgaactcaaatcactaacagcaaaagaaaaattaatgaccagctatttaagacagatatataggatgaaatttctcattacattatttatgcattccccttaattgtgtgcctaacacgtttaactgccttattttatttttttacaaacagggtctcactttgtcacccaccctgaggtgcagtggtgtaactatggctcac

SEQ ID NO: 731201 - DNA, 446 bp, Homo sapiens
  misc_feature (8)..(8): n is a, c, g, or t
  misc_feature (12)..(12): n is a, c, g, or t
  misc_feature (37)..(37): n is a, c, g, or t
  misc_feature (43)..(43): n is a, c, g, or t
  misc_feature (424)..(425): n is a, c, g, or t
  misc_feature (430)..(430): n is a, c, g, or t
  misc_feature (433)..(434): n is a, c, g, or t
aaaaattngggnaacctggtaccccttaaaagttggnccttantcctgtagttacttttaaaaagtatattaagaatattcaataaaaatgtgttatgctgaaacaaaaagacacatgaaactgcttgaaaacttcattgatatggttaggctttatgtctccacccacatctcatcttgaattataattcgcaggtgttgagggaaagacctggtgggaggtgattggattcatgggggcagtttcccccatgctgttctcatgatagtgagttctcacgagatctgatggttttataagcatctggtatttcccttgcttgcacttctctctcttgctgccatgtaaagaaggtccttgcttcccctttgccttccatcatgactaagtttcctgaggcctccccagccatgcagagacagnnggacnaannaacctcttttct

SEQ ID NO: 731202 - DNA, 2269 bp, Homo sapiens; identical to SEQ ID NO: 83320
  misc_feature (294)..(294): n is a, c, g, or t
  misc_feature (1561)..(1561): n is a, c, g, or t
  misc_feature (2042)..(2042): n is a, c, g, or t
  misc_feature (2045)..(2045): n is a, c, g, or t
  misc_feature (2072)..(2072): n is a, c, g, or t
  misc_feature (2129)..(2129): n is a, c, g, or t
  misc_feature (2176)..(2176): n is a, c, g, or t
  misc_feature (2201)..(2201): n is a, c, g, or t
  misc_feature (2213)..(2213): n is a, c, g, or t
  misc_feature (2224)..(2224): n is a, c, g, or t

SEQ ID NO: 731203 - DNA, 483 bp, Homo sapiens
acatgaacatggggcaggaaggagcatggagaagacaagaacaaggctctcagaaggaaatggtgtggctggagccatgagaactggttgtggagggggtgaggaaggcaaatataatttctgacctacgtaatgatgtatgcacaagaagcctctcttgaatgtattaattcagtaaacagttatggagtccttacaatgtgctagtgggactttgaagatgaatccaaatttggatcctggcctggaaaggctcaaagcccaatatgggagcctggatacaaatgtgaaacttatcttcttttattaaccaatcaatcacctcctgccaaaacaacatcagcaaaaacaacagaaaaaaacaaaaacaaaaacaaaaacaaatctgtgtacacaagacctttgtttccacagcagacttggctaaaggtttgggcatgcatatgcatacccccaaaattaaaaatggaaaattgaacactt

SEQ ID NO: 731204 - DNA, 356 bp, Homo sapiens
acatgaacatggggcaggaaggagcatggagaagacaagaacaaggctctcagaaggaaatggtgtggctggagccatgagaactggttgtggagggggtgaggaaggcaaatataatttctgacctacgtaatgatgtatgcacaagaagcctctcttgaatgtattaattcagtaaacagttatggagtccttacaatgtgctagtgggactttgaagatgaatccaaatttggatcctggcctggaaaggctcaaagcccaatatgggagcctggatacaaatgtgaaacttatcttcttttattaaccaatcaatcacctcctgccaaaacaacatcagcaaaaacaacaga

SEQ ID NO: 731205 - DNA, 295 bp, Homo sapiens
acaatgggcttctaagtcccctagagtcccagctgtgtaatttaaggcaaatataatttctgacctacgtaatgatgtatgcacaagaagcctctcttgaatgtattaattcagtaaacagttatggagtccttacaatgtgctagtgggactttgaagatgaatccaaatttggatcctggcctggaaaggctcaaagcccaatatgggagcctggatacaaatgtgaaacttatcttcttttattaaccaatcaatcacctcctgccaaaacaacatcagcaaaaacaacaga

SEQ ID NO: 731206 - DNA, 378 bp, Homo sapiens; identical to SEQ ID NO: 89261

SEQ ID NO: 731207 - DNA, 770 bp, Homo sapiens
tgaaatgacagataaagccataccatataacaacttattgaagatatattaaaactggcaggttaacccacatctagagccagaaagcataaatatttttgacattgattgtcacaaagaaataatgtgaaagtatagggtattttggcatacaaattttgtgtaaatgtcaagaattcaaaggcttttatatctttgtttttggtgaggaattactaatactaaacaactttgtattatcagatattaagactccttttcattctcactaatgttcatcttaatgttttccaaactacactttaaaaccagagctgcaatttctaccacactaatgggaaaatttctggcaataacttttttgcttttataagataaaatattggtgaatgatcaatatgtgatcaacagtcttctgcatgctatttagtataaaactgcctgtttggtttttaaactggaaccactatttacaaaggatgactttaattggctaattcagaaaaatgcagaattacaaaataatcaacaaatatctgtcaagtaccacctcgttgtgtcatttgccatgggatatataaaatcaagtgttaagatatggtccttgctctcacaaaacttaccaaggaactacctaagcaacaaaataattacttcatgaactaaattgcagcaattaaagccaggtgctgtggtacatgccactgcttaggaagctgaggctcaggagtttgaggccagcctggacaacgtaacaagacttcatgtca

SEQ ID NO: 731208 - DNA, 1488 bp, Homo sapiens
caggcttgggggtgggtaaggaagtagaagaagtgggagtggttatcttgctcaaatgagaaaagcctgaaggggtccagaggtaggagctaggaagctctagaagaaaatgtttagaagaagacagacccactctctccccttattacaaaagacagagccaaaaaagaaagggaataatgctgatcctgtttttatttaaaagtaggctattttgttcatcatggattttttgcattaattttgactttaaaataatattgcattaaagtcctatcttgattaataaattgttcaccacccccttaaaatttagtccccccaggtgaatgactcactttgctttaccccagtcctagccctggagactaagctgtaattgggaaggaggttagatctgggggtcggggatgtgtgggggagacaccagaaggcctccttagattctccttagatgaaggtctcctcaagtcaaaggtgggataacttccatgggttgctcaggaagccctcaagctcagatttacagtcccccaggcagtccttttcagactttctcctctagggttcctatttcagggacctcttaccctcataggagggggtcataaactgagcaaacacagacatcacgtttaccaaagaacacatgggttttgcgcaaactcggccttgggctgcagacattatcgacctcatggttcaggactgtccagccaaagggaggagatgtgggggaggacgggcaaaggtctaaaaaggacccagtctcagagcaaatgccaccctctcctcatccaggccttcctcttctccctgtcccactccagcagcccttgcccattccagcttccaggcaggactcctgggtggagcactgggggtgggtgaaaggaaggcaagtcagaggtcctggcagccagctctgagcatgcctctgcctcccacacttgcgtggagggattacagagggaacaggtaaagcctaggtttttattagccatgagacctcaaagatggttctggaaggatggagggacggggtgcctaagaaagaagaggcataaagtgtgagatggatacaatagttcagttctgaggagaccatgtgaagagacagcagagtaggcagactacagcataagcaggcaggctctgtgtcatctggggtgccagttagggcccttgtaggagatagaggacttttcagctgtctgtttttgcttcatcaagagaacttagtgaaggaattatttacagaggtataggcagagttaagggaaccagtatgagatgttgaggccccagggactagcaagatagaaagcctttaggaccccctagtgttgaagcagttatatcagaatgtaggcagagctggggccatggaagggggtagccaggtagtgtagggacacagaatagccacagttacacagaaccatgacacctagacagagagggaacagggataagaaatgccctgac

SEQ ID NO: 731209 - DNA, 540 bp, Homo sapiens
gacgggcaaaggtctaaaaaggacccagtctcagagcaaatgccaccctctcctcatccaggccttcctcttctccctgtcccactccagcagcccttgcccattccagcttccaggcaggactcctgggtggagcactgggggtgggtgaaaggaaggcaagtcagaggtcctggcagccagctctgagcatgcctctgcctcccacacttgcgtgcccacagctggtcagtttactggatgaccaagcatagatctgtctcatcttttggagggattacagagggaacaggtaaagcctaggtttttattagccatgagacctcaaagatggttctggaaggatggagggacggggtgcctaagaaagaagaggcataaagtgtgagatggatacaatagttcagttctgaggagaccatgtgaagagacagcagagtaggcagactacagcataagcaggcaggctctgtgtcatctggggtgccagttagggcccttgtaggagatagaggacttttcagctgtctgtttttgctt

SEQ ID NO: 731210 - DNA, 794 bp, Homo sapiens
ttcatggagtgcaacatgtaactttatattagaaaatggaatgtcacatctttaccatgggacagagacacaggaagatgtcaaagtctgaaatagcaagtgaagctgaatgtagcttatgatagggagggagggctctgctggacagggacagtctctgagcaggtgaactgctgatctcacagaggtcagcaatcggcggattttcaccgtgtaagtagactgaagtcatccgtagaagcacagacgtactggactgtcacatctactagaaaataaagcatctgccacctggggggtggggagggtccagtttagcccaatgggggacaacccagcacatccacctttggaacccaccagttaaaggtattgtcagagtatcctgtttgggaagaattcccatttcaggcaccctcgatgaagagccaggccaggaacatgggatgagagagcgaaatggtggaaaaaggggagataggctaattccagaggcacctgcccagccaacactcagccctggctgcgcgcactgagtcctgtgtctgctgcaggtatcgggctttccgggatgacgatggacattattcccagacctactggaatcttcttgccatccgcctggccttcgtcattgtgtttgaggtagccgaggcacctgctggttctcccatccatggcatgaggccccgaccctgtgctttgcctaattcgagcacgtggtgaggggtcggtgccgtcacttcctgctgtgtcatcttggtcaaatcagagctcttctctgcacctgcgtt

SEQ ID NO: 731211 - DNA, 413 bp, Homo sapiens
catgcggcaagagcgagtcgcaggaacaagtggggaatcttggccgcggccccctcccccgccttataaaaaagaaattgacttttgtttggagtttgtgaaaagtggggctcggggcccagtcaatggggcgccccgcggcgcgggctgagtggagctagcgcgaaccgctcagccgcggccccaattaatccgccctttgtgcggcccgcccggccgcccccgccggcacgcaccagcggcccattgttcggcctcgccgggccgcgggatttacccttttcaaacagccggttttgtccagggcagttcgagcggaagtttctcactgacaatttgccccaaatagatagatttgtcagaagcgacttcgggaaggaagcaaaaagccaccggcccgaaggttgggccca

SEQ ID NO: 731212 - DNA, 528 bp, Homo sapiens; identical to SEQ ID NO: 90986

SEQ ID NO: 731213 - DNA, 1022 bp, Homo sapiens
agatgttttgggctattttatgagaatatttactcataccacttggtataggttgttccaggctgtaaaattcaatgctgggtctgtgaatttatctgtttggcataatgcttctcttcacagtagctactcagtgtgtaaccaactaaataaaacagctataaattctttatgcaacatgtggtctgaaaaagtttgaggctttcctcatttgtgtcagattttccctgtcctgtattcagaaattgagtccataatctcagctcataaggtgcttgataattctaatataacaactaaaactgtcaaatgaagtctcttattctgagaaataataagtctttgtgactgtcataaaacaggaaacaatttttgtttgtttttagagacatagtctccctgtgttgcccaggcttgtcttgaacttctgggctcaatggatcctcccttcctcctaagtagctgggattgcaggtgcatgcctgagaaataataattcttgccgctaatttagtccttctgtatgttattttaagtaagtatttagtctgttcctttagtaattcttctataagtcatggaagacagctactgttggtaactgctggaatgatgtgcagactgagaatatgaaaacagaaactctgacactgaaagtgattggtcacataggcaaatgttgatttattttccaaaaaggaacctggaagagtgaggagttattttctagagttaacctgaagcagtggccgagtgccatgcacacgtgtaatctcagcactttgggaggccaaggcaagaggatcacttgaggccaggaatcgagaccaggctggccaacatggcaaaaccccatctctactaaaaatacaaaaattatctgggcatggtggcacgtgcctgtaatcccagctagggaggctgaggcacaagaatcacttgaacccgggaggcagaggttgcagtgagccgagattgtgccactgtgctccagcctaggtgacacagcaagactctctctc

SEQ ID NO: 731214 - DNA, 311 bp, Homo sapiens
  misc_feature (110)..(110): n is a, c, g, or t
  misc_feature (137)..(137): n is a, c, g, or t
  misc_feature (222)..(222): n is a, c, g, or t
  misc_feature (224)..(224): n is a, c, g, or t
aagtcacttgccctggctctaccttgaagtggttctcagggttggggcgagagtcggggtggggaccgagatgcagctctatcctgtgcccctggtcgcagcaggcagcnccagttcgcgtgttctacttggcctgntcctgccgcctaatgagctcaggtctaggccgagcagagggggcacctggtcggactcggttgggctcggcggccccgccctccncncccccccaggcgggcccttctcgacggcgcggggcggctgcgggcgcggggctgaaggcggaaccacgacgggcagagagcacggag

SEQ ID NO: 731215 - DNA, 1219 bp, Homo sapiens
taaatttaaaaaatgtatctataaaccaagaacagagtctgatatgaaatagacaaactttaataaggaaaaatgcaaaatccggtagttaaaaagcatgatggcaaaactgaagggtagaaggaggcaggagtttttgcaaaataaccagggaattttaatttcaaattaaatataagccaatagtgcaatgcaaccgataaagggaaaaatcaaatacaactgatcaagttggaaaacagtgagctattgggcttcattaatccacaaaaggaaatatgtggtaaagttggaatcacacctggcctatttatacaactttcaggccacacattaaggggaacattggcaaactgatcttctgcctggatgttttatccattattaaaaggggaatattgaagtctaccactattattgtattgctgtcaatttctccattcagatatgtcaatatttgctttgtatatttaaatgctctagtattgaatatgtatatacttataattgttatatcttcttactgaattgatcattttgtcatatggtgacctttatctctagagacaattttcaattttaagtctgttttgcctgacataaatatagccatttctgctttctttttgttaccattttggaatgtctttttctatcttgtcactttcagcctatgtgtatctttacatctagggtgggtttcttgtagatagcaagtcactggatcttgttttcttcataattcagtcttgacgtattgttatattagttcattttcacagtgctataaagaaatacccaagactaggtaatttataaaggaaagaagtttaattgactcacagttccatatggctgtgctgggggaggtcaagtaacttacaatcatggcagaaagcaacggagaagtaagtaccttcttcacaaggcagcgggaaagataaaacgaagggagaagagcctcttataaaaatctccagatctcctgagaactcactcactatcaagagaaaagcctgggggaaatcacccttatgatctaatcacctcttacctagtccctgccgtgacaagtgtggattacagtcagagatgagatttgcgtggggacacagagccaaaccatactgcttgtatatttataagaattcatcaatttcttctatattatccaatttttggcacataattgtaaataaaagtcccttatgatctttta

SEQ ID NO: 731216 - DNA, 1459 bp, Homo sapiens
tgcgatttgttaaaatacagtatactcacagcttttcaaagaaattactgtgtaatgtaagatgcctttttatatagaacatcaatgaaactaaatacttcactttatatttttgtagacttactaattactcatttcagaaacatttattaagcacatactagatatcaagtatttcaaggcactatagatttagagagaagaaaataagaattgtaaaattgagaaggtcatgtttgacttgtacttcaaggactgccaatggatttaccaaatatagaagcagagaagggaattttattcaaaagtgacagcatggacaagggcacagaagtttaaaagagcatggaactttttaaaatataaaataggtcagtgtgattacagtatagtttttatggaggggagtaaaaagataaattggaaataaaaccagagtgtcctatatgcaattcttaatacttggaattaattccatgggaaataggaaacagggagagtcataatcaagctgtatatttataaatatagtagtgatggtgctgttcacaaataacgttgatgagaaataatttggaatggttaaaagcaaagaaactcattaatatggaatagattgtgggagagaggagaaagccttgtttcaaagcattaattctaaataatcataattataagataaagttgtacacatctataaataaataaatacagcttatattataaatactatataatattgaaattataagtataatataaatatagctttaagtaaatcattacaaaaatgtcagttaacaatggaagactgtgagagagaggattaaaacaagagcaaaacagaaaactattaacaaaatggcagttagtaagtcctcagcaatcagtaattattttaatgtaaatggcttaatatcccaaataagaatgcttaaagtagctgagtgaatcaagtcactggatcttgttttcttcataattcagtcttgacgtattgttatattagttcattttcacagtgctataaagaaatacccaagactaggtaatttataaaggaaagaagtttaattgactcacagttccatatggctgtgctgggggaggtcaagtaacttacaatcatggcagaaagcaacggagaagtaagtaccttcttcacaaggcagcgggaaagataaaacgaagggagaagagcctcttataaaaatctccagatctcctgagaactcactcactatcaagagaaaagcctgggggaaatcacccttatgatctaatcacctcttacctagtccctgccgtgacaagtgtggattacagtcagagatgagatttgcgtggggacacagagccaaaccatactgcttgtatatttataagaattcatcaatttcttctatattatccaatttttggcacataattgtaaataaaagtcccttatgatctttta

SEQ ID NO: 731217 - DNA, 1060 bp, Homo sapiens
tgcgatttgttaaaatacagtatactcacagcttttcaaagaaattactgtgtaatgtaagatgcctttttatatagaacatcaatgaaactaaatacttcactttatatttttgtagacttactaattactcatttcagaaacatttattaagcacatactagatatcaagtatttcaaggcactatagatttagagagaagaaaataagaattgtaaaattgagaaggtcatgtttgacttgtacttcaaggactgccaatggatttaccaaatatagaagcagagaagggaattttattcaaaagtgacagcatggacaagggcacagaagtttaaaagagcatggaactttttaaaatataaaataggtcagtgtgattacagtatagtttttatggaggggagtaaaaagataaattggaaataaaaccagagtgtcctatatgcaattcttaatacttggaattaattccatgggaaataggaaacagggagagtcataatcaagctgtatatttataaatatagtagtgatggtgctgttcacaaataacgttgatgagaaataatttggaatggttaaaagcaaagaaactcattaatatggaatagattgtgggagagaggagaaagccttgtttcaaagcattaattctaaataatcataattataagataaagttgtacacatctataaataaataaatacagcttatattataaatactatataatattgaaattataagtataatataaatatagctttaagtaaatcattacaaaaatgtcagttaacaatggaagactgtgagagagaggattaaaacaagagcaaaacagaaaactattaacaaaatggcagttagtaagtcctcagcaatcagtaattattttaatgtaaatggcttaatatcccaaataagaatgcttaaagtagctgagtgaatcaaaaaacatgatccagtgacttgctgtctataagagactcactttagatttaaaaatacatataggctggaagtaaagagatggaaaaggatattatgaaaatggt

SEQ ID NO: 731218 - DNA, 536 bp, Homo sapiens
ccaggaaggaggggcttagcttcggccgccattctgaggcagccacctccacccccacccccaccgcaacagccagccaaggcgctaggagtctccagctgccggcctcagctggtgcactagtaccgcagtcccagcaccttgcccggaatcccgtcaccccgcaggatggggcagggacaggtcatcttcaagccaagggaagagcaggttcactgccacccgcgatccccttttcttcctggatcttacagccaggctagggggcgtcgaacccaatggggccttagatcattccttgtccggaacagaatctctgcggaaccgccagacagacacacagctgctgctgcggatactggcttcttggggccaagacctcaacatgcaggacctcacatttccagcgatgcacacgttttttgagaacatcccgacctttcctcctccccaggaagatgctgcagacgtgcccgccatcccaggtctcgaagagctcttaaggcaaacctccggcacccgggccacacccaccg

SEQ ID NO: 731219 - DNA, 357 bp, Homo sapiens; identical to SEQ ID NO: 324528

SEQ ID NO: 731220 - DNA, 701 bp, Homo sapiens
  misc_feature (8)..(8): n is a, c, g, or t
ttgtcttnttattaatggccatttggactggtgtgagatgatatctcattatggtttagatttgcatttttctgatgattagtgatggcttttctctagggtgaaggtacactcgagcgtggtcattgaggacaagtcgacgagagatcccgagtacgtctacagtcagccttacgagtggactgatcaagttgaaagcaacagaacaagcatctataagaattgattatatgtcccagcactttggaaggctgaggcaagtggatcccttgggcctaggacttcgcgagaccagttgggcaacatgatgaactcctactaattttcgtccttcagaacaagatggaagaaactacggtcacatatgcaaatggagaagatgatgaacacagaaaaattatgcaaagataatccctaaaccttctttctcatcaaaagttatagcaaggtggtttaatatatcactgacggaacacgatgctttgtttaatgaagactcagacggaaaggatcagacatcaacctataaatgcatcaaccagaaggaaagaccaattttgaaaactgttgagcattattctatacctctaagctgttcttttctgaaccatgaatcgggagaattattgtcactcatacatgagtatgagttgtaattctcaattcccaagtaaaaatcttcctgcttttgttatattttt

SEQ ID NO: 731221 - DNA, 1096 bp, Homo sapiens; identical to SEQ ID NO: 64859

SEQ ID NO: 731222 - DNA, 672 bp, Homo sapiens
  misc_feature (8)..(8): n is a, c, g, or t
ttgtcttnttattaatggccatttggactggtgtgagatgatatctcattatggtttagatttgcatttttctgatgattagtgatggcttttctctagggtgaaggtacactcgagcgtggtcattgaggacaagtcgacgagagatcccgagtacgtctacagtcagccttacgagtggactgatcaagttgaaagcaacagaacaagcatctataagaattgattatatgtcccagcactttggaaggctgaggcaagtggatcccttgggcctaggacttcgcgagaccagttgggcaacatgaacaagatggaagaaactacggtcacatatgcaaatggagaagatgatgaacacagaaaaattatgcaaagataatccctaaaccttctttctcatcaaaagttatagcaaggtggtttaatatatcactgacggaacacgatgctttgtttaatgaagactcagacggaaaggatcagacatcaacctataaatgcatcaaccagaaggaaagaccaattttgaaaactgttgagcattattctatacctctaagctgttcttttctgaaccatgaatcgggagaattattgtcactcatacatgagtatgagttgtaattctcaattcccaagtaaaaatcttcctgcttttgttatattttt

SEQ ID NO: 731223 - DNA, 1196 bp, Homo sapiens; identical to SEQ ID NO: 64864

SEQ ID NO: 731224 - DNA, 1029 bp, Homo sapiens; identical to SEQ ID NO: 64869

SEQ ID NO: 731225 - DNA, 1125 bp, Homo sapiens
tgacttaaaactagagaggatctaggaactggagctgctgcctctgtctgctaagatgtgaagtccaagactgaaagtaacatagcagaaggagaaccaaaagatatgttgagtcttgatgctatttgttgaaccagtcctgaatccagctgtgtcggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggatatgttctgggagtaactcccctgctttccctggatgtgtgcgagaaagcataggcatccactttctgaccaacaggagacccagtctcaggatggagcagacaccatgcatggtagagcagagagacagatacaacctaggtccttgatgaaatgattggccactggatcagccacagttaaagactgcctacctttggacttctggttatcttaggccaaaaatgtcctttttgtttaaggcactttgagccgggttttctaagacctagcagtctcaaccatccaaactaataagctgaattaactagatttcctgtcatgtccttcctgcctgattggtagcccttgactccaatttggcctcattttccgtaccttactggctgccttttcctctactcataggtcacttggaaataaaatatagatttacttcaaactcccactatcacatgcatttcttttcttactgacttcacggccttcaaatacggcctcataatcatttactctctgttaggttcctccaatgacttggatcactcctagcctgtcttgattggccacctccacactaatgccaaaaa

SEQ ID NO: 731226 - DNA, 1028 bp, Homo sapiens; identical to SEQ ID NO: 64860

SEQ ID NO: 731227 - DNA, 654 bp, Homo sapiens
tgacttaaaactagagaggatctaggaactggagctgctgcctctgtctgctaagatgtgaagtccaagactgaaagtaacatagcagaaggagaaccaaaagatatgttgagtcttgatgctatttgttgaaccagtcctgaatccagctgtgtcggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggtctgttgtggggaaagtcagatgatgtgagtccttgttcacacagtaagtgcccagaaaaccttggtgcttttcctcttcccttccctgaagctgaacttctgcggaaaaatccaagagg

SEQ ID NO: 731228 - DNA, 852 bp, Homo sapiens; identical to SEQ ID NO: 64865

SEQ ID NO: 731229 - DNA, 823 bp, Homo sapiens
gaaaatgtgacaggatatatgcagtttccttaggggcacattctgagatgcttggatgacccacaaggactttgttaaacacaaatcccatcaggaaacaggcagttcactatgaccttatgaaagttttaattcaaagcacttgaagatacttttttttctgggcttcctgatcttacttcagtaaggtttttataaagttaatatccaagtaagagtatagctttcaaaggctattcctcattcttaaatgcattaaactgttgattaataacattatctaaaagctgtcaaataaaaataagaccaaactctttacttgtacagagtggactgatcaagttgaaagcaacagaacaagcatctataagaattgattatatgtcccagcactttggaaggctgaggcaagtggatcccttgggcctaggacttcgcgagaccagttgggcaacatgaacaagatggaagaaactacggtcacatatgcaaatggagaagatgatgaacacagaaaaattatgcaaagataatccctaaaccttctttctcatcaaaagttatagcaaggtggtttaatatatcactgacggaacacgatgctttgtttaatgaagactcagacggaaaggatcagacatcaacctataaatgcatcaaccagaaggaaagaccaattttgaaaactgttgagcattattctatacctctaagctgttcttttctgaaccatgaatcgggagaattattgtcactcatacatgagtatgagttgtaattctcaattcccaagtaaaaatcttcctgcttttgttatattttt

SEQ ID NO: 731230 - DNA, 1280 bp, Homo sapiens; identical to SEQ ID NO: 64868

SEQ ID NO: 731231 - DNA, 1217 bp, Homo sapiens
tgacttaaaactagagaggatctaggaactggagctgctgcctctgtctgctaagatgtgaagtccaagactgaaagtaacatagcagaaggagaaccaaaagatatgttgagtcttgatgctatttgttgaaccagtcctgaatccagctgtgtcggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggttattttttccacagatgaatttctaatcctaaataatcatttacatgaattcagatttttttgatccagcttttctctagggtgaaggtacactcgagcgtggtcattgaggacaagtcgacgagagatcccgagtacgtctacagtcagccttacgagtggactgatcaagttgaaagcaacagaacaagcatctataagaattgattatatgtcccagcactttggaaggctgaggcaagtggatcccttgggcctaggacttcgcgagaccagttgggcaacatgatgaactcctactaattttcgtccttcagaacaagatggaagaaactacggtcacatatgcaaatggagaagatgatgaacacagaaaaattatgcaaagataatccctaaaccttctttctcatcaaaagttatagcaaggtggtttaatatatcactgacggaacacgatgctttgtttaatgaagactcagacggaaaggatcagacatcaacctataaatgcatcaaccagaaggaaagaccaattttgaaaactgttgagcattattctatacctctaagctgttcttttctgaaccatgaatcgggagaattattgtcactcatacatgagtatgagttgtaattctcaattcccaagtaaaaatcttcctgcttttgttatattttt

SEQ ID NO: 731232 - DNA, 429 bp, Homo sapiens; identical to SEQ ID NO: 95785

SEQ ID NO: 731233 - DNA, 1453 bp, Homo sapiens
tgaagcatgaaaagttaacatcatttgttatcctttctttccccactatatattgtcttacccagagtagggctatactttggtggtgttttaacatcttctaataagtgatcataagcaacatacagatgctaatatttgaaatcttgttttttcttacttcctaataatcaaattatattaatatttcacactacaaaaaaataggattttctaatttgtaaaaacaagagctcctgctatctcttggaagttaagtccttaggaaccctatcttatctttctaaaaataataagtaagaacaatcacatgtgattctggctattaaaatcatacatccctagtggaattaacaagcttgaccaattatgattatgctaaattgttttaggctaggaggactgtcagtccctacttcttcccatttttcttgggatatctttatattggctagatttgttgccaatataaaattgacacagcagagacactcctctaacttaaatttttagtggagtttggtttttgctaaccccgtactaataaacactttaatgacttttttcatttcaaaatatttaaatgtataaaattgcctatgctgcttattgaaagaaccgtccttttgggcataagaagactttttcaacctaaaccgttatgtgtgatttattaacaacttaacaaagaaagtaccaacatctctcaaaatgtagttgatattcttacctatctcagaaatattaacgaattggattcacaaaagaatgtcttacatactgttgacatttatgtgaatattctttatactgttgtaaatgtttcattcaacttaataacattttaaaagatgtatgtatctgatttttctttagaaaatattatatttttatttgtattttttacattttaaagttcatctctatgtgcagctatttttatattgccaaaaactcacataaatacaaaataagtgaaatatgcaaaaaaaaatattttggcaagcattacactgcatatttttttaaatgtttgtgggccagtctcatacaattgattattctaagaatgtgttgtgtcttatcactgtaaatatggcacaaacctgtttatctcagtagtgtaaataattgaaagattgaattctccctgttcaatttttattttaatttccttgtaatttctccagctgacattactgtatcaaaagatgcataagatttttgatttgcggtttggagataattgcattgtgttcagtttccagtttgtttttatttgctttttaaatttgttttcagggttcctagtttgtgagaagttgatcttcagaattatttttacactatttatgacttattttcataatgtaaaaagtgtgtaattattacaatattaatccaaacaatgataatgaattgtattgttataaagctttattgatgttcatga

SEQ ID NO: 731234 - DNA, 496 bp, Homo sapiens
cctgggaggcaggggttgcagtgagcagagatctcgccacttgcactccagcctgggtgatggagcgagactctgtctaaataaataaaaatacaaaaattaggcctgacctcaagtgatatgcctgcctcggcctcccaaggtgttgggattacaggccactgcgcccagcctaaaacaacgtttgaacattagaattaagaattttttttttgtagagattggggggtgtctcactatgttccaggctagtccagaactcctgagctcaacctatccttcagccttgacctcccaaaatgctgggattacagatgacagccacctaactcagataccactttctttttaaatatagacttcccgggccaggtgcggtggctcatgctcgtgatccgcctgcctcggcctcccaaagtgctgggattacagatgtgagccgccgtgcctggctatccactgataattcttgctggaattaattcctgtcatgatg

SEQ ID NO: 731235 - DNA, 2265 bp, Homo sapiens
gcgatggcgatgatgcctctagtcctgcatcatccagagcggcaggcgagctggggtccggactgcgagatggaggaggggcggcgctgcggcacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctgctctttgcctcagtcttttgtaccgagcctttaaatagatgccaggaatgaagctactgtgttaaagtagaaagtcaaccgattatcatgatttgagtcagtgttatgtgacttcaaaataaggtattgactggattttttttaaagaatgtgaaaatatgatttttgctgaggtgttatttttattaattgaattgtaaattttgattt

SEQ ID NO: 731236 - DNA, 640 bp, Homo sapiens; identical to SEQ ID NO: 403138

SEQ ID NO: 731237 - DNA, 290 bp, Homo sapiens
  misc_feature (173)..(173): n is a, c, g, or t
  misc_feature (175)..(175): n is a, c, g, or t
  misc_feature (245)..(245): n is a, c, g, or t
  misc_feature (281)..(281): n is a, c, g, or t
acggagccccacacagtgccttcccccaaccatgagccaattctgtcacagtccgaaatagactttttctaagggtttcgtgtccctcttttatccgtcgcagtgtaaagggtctgatccgcagcctgcattgtgcgcgcaccgaggcaggagcggatgtcttctgaggagancnctggctggggttgactctcaggctcccggctgtccgcccgcccacacgcagcgaggaggggcggactgcntttccggaatgcttaaaatatggggaatttcttagngtcaatgga

SEQ ID NO: 731238 - DNA, 679 bp, Homo sapiens; identical to SEQ ID NO: 728765

SEQ ID NO: 731239 - DNA, 901 bp, Homo sapiens
ccccgcttccagtcagagttcaagttaaaacagaaaaaaggaagatggcaagaatattgttacttttcctcccgggtcttgtggctgtatgtgctgtgcatggaatatttatggaccgtctagcttccaagaagctctgtgcagatgatgagtgtgtctatactatttctctggctagtgctcaagaagattataatgccccggactgtagattcattaacgttaaaaaagggcagcagatctatgtgtactcaaagctggtaaaagaaaatggagctggagaattttgggctggcagtgtttatggtgatggccaggacgagatgggagtcgtgggttatttccccaggaacttggtcaaggaacagcgtgtgtaccaggaagctaccaaggaagttcccaccacggatattgacttcttctgcgagtaataaattagttaaaactgcaaatagaaagaaaacaccaaaaataaagaaaagagcaaaagtggccaaaaaatgcatgtctgtaattttggactgacgttttaagaatttgttaccttacagaagagcaagggcttaggggttggaggtggcagataaaagaggattttcaactcaaatcttgtttcctgctggcctggtctgcccacgagctagagcggggaaatgttgagctcaaatgggtaaattgagaccagaaaattattttttcaacctagagaatctcctcttacagggggatgcatataacagatcatgtatgtgtagttatttctaagtagtaattcttcccagctctttgatttgccatatataaaataggtgggtcgtatgtcttccctttagacatgatgttttctactcatttgtctctctggccaattgaattattaataaaaggtctgtattatcaa

SEQ ID NO: 731240 - DNA, 1466 bp, Homo sapiens
ccccgcttccagtcagagttcaagttaaaacagaaaaaaggaagatggcaagaatattgttacttttcctcccgggtcttgtggctgtatgtgctgtgcatggaatatttatggaccgtctagcttccaagaagctctgtgcagatgatgagtgtgtctatactatttctctggctagtgctcaagaagattataatgccccggactgtagattcattaacgttaaaaaagggcagcagatctatgtgtactcaaagctggtaaaagaaaatggagctggagaattttgggctggcagtgtttatggtgatggccaggacgagatgggagtcgtgggttatttccccaggaacttggtcaaggaacagcgtgtgtaccaggaagctaccaaggaagttcccaccacggatattgacttcttctgcgagtaataaattagttaaaactgcaaatagaaagaaaacaccaaaaataaagaaaagagcaaaagtggccaaaaaatgcatgtctgtaattttggactgacgttttaagaatttgttaccttacagaagagcaagggcttaggggttggaggtggcagataaaagaggattttcaactcaaatcttgtttcctgctggcctggtctgcccacgagctagagcggggaaatgttgagctcaaatgggtaaattgagaccagaaaattattttttcaacctagagaatctcctcttacagggggatgcatataacagatcatgtatgtgtagttatttctaagtagtaattcttcccagctctttgatttgccatatataaaataggtgggtcgtatgtcttccctttagacatgatgttttctactcatttgtctctctggccaattgaattattaataaaaggtctgtattatcaaagagtattctagtatttttgttacttttaatatttgatgccttttggaggtaaagctgttgggggaagaagagtttttggacccatagatgtttggatgatgtctctaatttgtcatttagaaaaatctcaaaaatgatttcagttgaataacttgccttctaaatgatcaatttacttctcccccaattttaaagaagtatgtgtatatttaataggggaaggtagtttatggaaatatttttaatggaatagttttcccttaatatgtatccttgctggatattattcaagctgcaagtcatcaaaagacccagaaaaaaaaaagtctgtaggttattttctctacttctatttcaactttgaatttcctcttcctgtgcaaattcctctagtcaagtgtgatatatcaagaaatctgaggaggatgcaggttttgtggtcctgatgggcccacaagtttttctatatttaactggaaatatgctttgattttgtgttattaatataattcttttgatgtagtcatgagtttttctttgtttgcatataattaaaatgcctct

SEQ ID NO: 731241 - DNA, 848 bp, Homo sapiens
ccccgcttccagtcagagttcaagttaaaacagaaaaaaggaagatggcaagaatattgttacttttcctcccgggtcttgtggctgtatgtgctgtgcatggaatatttatggaccgtctagcttccaagaagctctgtgcagatgatgagtgtgtctatactatttctctggctagtgctcaagaagattataatgccccggactgtagattcattaacgttaaaaaagggcagcagatctatgtgtactcaaagctggtaaaagaaaatggagctggagaattttgggctggcagtgtttatggtgatggccaggacgagatgggagtcgtgggttatttccccaggaacttggtcaaggaacagcgtgtgtaccaggaagctaccaaggaagttcccaccacggatattgacttcttctgcgagtaataaattagttaaaactgtgcatgtctgtaattttggactgacgttttaagaatttgttaccttacagaagagcaagggcttaggggttggaggtggcagataaaagaggattttcaactcaaatcttgtttcctgctggcctggtctgcccacgagctagagcggggaaatgttgagctcaaatgggtaaattgagaccagaaaattattttttcaacctagagaatctcctcttacagggggatgcatataacagatcatgtatgtgtagttatttctaagtagtaattcttcccagctctttgatttgccatatataaaataggtgggtcgtatgtcttccctttagacatgatgttttctactcatttgtctctctggccaattgaattattaataaaaggtctgtattatcaa

SEQ ID NO: 731242 - DNA, 834 bp, Homo sapiens
agagtattctagtatttttgttacttttaatatttgatgccttttggaggtaaagctgttgggggaagaagagtttttggacccatagatgtttggatgatgtctctaatttgtcatttagaaaaatctcaaaaatgatttcagttgaataacttgccttctaaatgatcaatttacttctcccccaattttaaagaagtatgtgtatatttaataggggaaggtagtttatggaaatatttttaatggaatagttttcccttaatatgtatccttgctggatattattcaagctgcaagtcatcaaaagacccagaaaaaaaaaagtctgtaggttattttctctacttctatttcaactttgaatttcctcttcctgtgcaaattcctctagtcaagtgtgatatatcaagaaatctgaggaggatgcaggttttgtggtcctgatgggcccacaagtttttctatatttaactggaaatatgctttgattttgtgttattaatataattcttttgatgtagtcatgagtttttctttgtttgcatataattaaaatgcctctacttaatgtcacaattctgagttttttctaaaacatttttcaccttagagaatgaaagtgtgggggagttgggaatgaagcttgtttttcagttctctgtgatctggacatcccctaagcatgaagaagagagcagaagagggcatttagggtgagccacagacttggcccagggtcattttttagctctgtcagctgtgattttgggtgaatatctttttaccaaattcttatgtaggtcggtcaagtaaagtaccaaaatgcaaaac

SEQ ID NO: 731243 - DNA, 786 bp, Homo sapiens
tgcgcaagctggagtgcaatggcgtgatcttggctcactgcaacctctgcctcccgggttcaagcgattctcctgcctcagcctcctgagtagctgggattacaggcacgtgccactacgttcagctaattttttgtatttttagtagaaatggggtttcaccattttagccaggctgatcttgaattcctgacctcaggtgatctgcccgccttggcctcccaaagtgctgggattacaggcatgagccactgtgcccggcctgaatatgtccaactgatttttggcaaaagtggaaaagcaattcaatgcagaaaggacacacttttcaataacttatactagaacaactggacatgcatgagccactgcatctggcaagtttttcatatattttgaatatcaatccctcatcagatatatgatttgcatgtatttttcctatcctatgggttgctgtttcagtctgttgatactattctttgatacacaaaagttttaaattttcatgaagtccaacttatttttttttcttttattgcccactcttttttttttgacagggtcttgcactgtcacccaggctagagtgcagtggcaaattctagactcactgcagcccctgcctcccaggttcaagcaattctcctgcctcaccctcccaagtagctgggattacagtcatgcaccagcacacctggctaatttttatgtttttaatagagagggggttttcccatgttggccaggctggtctcaaactcctggcctcaagtgatccgccca

SEQ ID NO: 731244 - DNA, 1069 bp, Homo sapiens
ctcccaaagtgctgggattacaggcatgagccactgtgcttggccacctttgaaactttttaagtgtacagttctgtggtattgagtgcatttacattgttgtgccatctttaccacccttatccacagaattattttcattttataaaactgaaactctgaacctattaataactctctatagtcttttctccccagcccctggcagccaccattctactttctgtctccgtgagtttaactactttgtgtacctcatataagtggaatcatacagtatttgaccttttgtgactggcttatttcatttagcgtaatgtcctcaagattcatccatgttgtagcatgtgtcagaattttctctttttttttttttggagatagggtctcgctctgtcatgcgtgctgaagtgtagtggctcaatcatagctcactgcagccttgacctcctgggctcaagtgatcctcccacttcagcctcctgagtagctgggaccacaggcatgtgccaccacgcctggctacttttttttttcttttttgtagagatggggtctccttatgttgcccaggctggccttgaactcctgggctcaagcaatccattccgccttggcctcccgaagtgcaaggattacaggcatgagccactgcatctggcaagtttttcatatattttgaatatcaatccctcatcagatatatgatttgcatgtatttttcctatcctatgggttgctgtttcagtctgttgatactattctttgatacacaaaagttttaaattttcatgaagtccaacttatttttttttcttttattgcccactcttttttttttgacagggtcttgcactgtcacccaggctagagtgcagtggcaaattctagactcactgcagcccctgcctcccaggttcaagcaattctcctgcctcaccctcccaagtagctgggattacagtcatgcaccagcacacctggctaatttttatgtttttaatagagagggggttttcccatgttggccaggctggtctcaaactcctggcctcaagtgatccgccca

SEQ ID NO: 731245 - DNA, 847 bp, Homo sapiens
gacatagtggtctttagtagcacatgagaaagactatccccagtgatgtgcttatgatgttgtgttctcattgtagcctagggcttttcctcgcctcctctgtttccttttccctagagccctgtgtcagcggcaatgaatgcttaagtaggctctgtcaggaaaacgctccgtgaccttggaaacggtatttaacctttctgtggatcagcatccaaatagcaaagcaataatgacaggagctgcctccttcacaagcctatgagttgtgactaagaaaagggattgtaaaacactctgaacatcttaaatactacggacaaatctaacaatgttaatcactcaccagctcatgcccagtggtcatcaccagacccttaaaatcagttggctttctaggagtcctaggtcacttcctgctggaaatggcaacaattttcaccagcattagatgcttgtttataagaaaactgtggattttctgaaataaatgtgaggtcgatcaatgctataacaaagtgcttttcccgtggttaagctgaggttatgagtgctttagtgtggctccattgaccagcactaacttcatgaaaatatttagaaaaagtttttgaaaacatatttttttaaggagaagaaaacagatttggcataagttatatgacagccacagtgaggctttcttatatatgaaagacattgacaatcagtcccatggggtttatgtaatttgagaatatagctttaaaaatcatattacaggcagcagtacttaagattaatacagaggccatttacctttttattacgtgttttattagcacttagcagcttgacttatgaaaga

SEQ ID NO: 731246 - DNA, 609 bp, Homo sapiens
ccatgtctgtcctgtctgaacttcggtgactcttcacaaaatagtacggtaagaaaattatttccatccatttcaggcttttgcagactttctgcattaacagagttaggggtaacaggcttagcatcctttgcatatgagagcctttctagccgccatggctggcaggttgtgaagggtgcctactgcaccctggcctgtcctggggagcctagacacgagctctgtgacagccatgctcctggggctgctccctactcctgtttttagaaacaagcatataattacttcattgataacagtcacagtggagcctagcaaccgatgaaaggaaatagagaaagaaaaagagaaagcaggaaaagaagggtgggatgattttttcctgtagggtggagttcatttccatggcttgattttcacacaggagatggtgttgtataattctgttggaactttcttttcagcacaattaagaattataatcaagtaaaatgttttccatttaatccaacatatgttaatttctttttgaattttaataaagttccttatttttctcaaaattgactgctgaatatctgacagcataaatcaattgtattctaa

SEQ ID NO: 731247 - DNA, 741 bp, Homo sapiens
aatggaaggcattctggcttcacatattatcacatgccccatcatttcacctagatagacgacaaaagctttcctgggaacattaaagacataataaatgtgtgttcacttacagagctttggatattttctgagctgtgtcagtcagttctgctgtcctttgctttggtcgttggcctcagtctcttctatctgcgcgtcaccattgcttggatctgagatgattcttttgctcagttgttgttggatgtctgactcaaactgaatcactggtgctgcatcaaaagagaatgagaagagcctagataagtggaatgacattctgtttaattatttagctcttccttaagaggatcgatcattgtatttccagttttagagcttctcaacattctcttaaaatgagtcagaactatctttcaggctcacttaaaatgttaccatggggagttttatgggaagaaaggctaagagaaggtcaaattagcaaatataatactaaattttccaggatttcagatacgatcctgcttggtcgtgtcctatttttggttagatgtgagaaagataagtgtcttcttttcagccattagtacccatataagaatgagaaaatattttcttaatgagtcacttcctgttttaagagattatgtaattgtcctgtacttctggttttggtcagttttgtttcattcatcagtagatgttgtacgtatatctgttgtatgagagaatcat

SEQ ID NO: 731248 - DNA, 2037 bp, Homo sapiens; identical to SEQ ID NO: 114042

SEQ ID NO: 731249 - DNA, 1848 bp, Homo sapiens; identical to SEQ ID NO: 114044

SEQ ID NO: 731250 - DNA, 2062 bp, Homo sapiens; identical to SEQ ID NO: 114045

SEQ ID NO: 731251 - DNA, 1973 bp, Homo sapiens; identical to SEQ ID NO: 114043

SEQ ID NO: 731252 - DNA, 1967 bp, Homo sapiens
  misc_feature (1268)..(1268): n is a, c, g, or t
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagaggtgggtaggaggttnaggaggatcctgagcacctgagcgcttccttttcaggaaaggatgctctgcttttctgtcaacggagtgttcaaggaaggtggtggtgtttgttgtctctgaagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 731253 - DNA, 1083 bp, Homo sapiens; identical to SEQ ID NO: 114019

SEQ ID NO: 731254 - DNA, 903 bp, Homo sapiens; identical to SEQ ID NO: 114018

SEQ ID NO: 731255 - DNA, 566 bp, Homo sapiens
aggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaacaagagtgaaactccatctcaaaataaa

SEQ ID NO: 731256 - DNA, 5956 bp, Homo sapiens
  misc_feature (1233)..(1233): n is a, c, g, or t
  misc_feature (1341)..(1341): n is a, c, g, or t
  misc_feature (2100)..(2100): n is a, c, g, or t
  misc_feature (2308)..(2308): n is a, c, g, or t
  misc_feature (2385)..(2385): n is a, c, g, or t
  misc_feature (2394)..(2394): n is a, c, g, or t
  misc_feature (2409)..(2409): n is a, c, g, or t
  misc_feature (2413)..(2413): n is a, c, g, or t
  misc_feature (2418)..(2418): n is a, c, g, or t
  misc_feature (2445)..(2445): n is a, c, g, or t
  misc_feature (2448)..(2448): n is a, c, g, or t
  misc_feature (2919)..(2919): n is a, c, g, or t
  misc_feature (3119)..(3120): n is a, c, g, or t
  misc_feature (3123)..(3123): n is a, c, g, or t
  misc_feature (3140)..(3140): n is a, c, g, or t
  misc_feature (3552)..(3552): n is a, c, g, or t
  misc_feature (3946)..(3946): n is a, c, g, or t
  misc_feature (3987)..(3987): n is a, c, g, or t
  misc_feature (3993)..(3993): n is a, c, g, or t
  misc_feature (4197)..(4197): n is a, c, g, or t
gaattcacagatagagagactctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaggtggtggccgcctaccggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcngcctacctcatggggctgaactcagctgacctgctcaaggggctgtgccaccctcgggtgaaagtgggcaacgagtatgtcaccaaggggcagagcgtgcagcaggtntactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgnatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggncagagaagctgctcagctctctggacattgatcacaaccagtacaagtttggccacaccaaggtgttcttcaaggcngggctgctngggctgctggagganatgngggangagaggctgagccgcatcatcacgcgnatncaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagangagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggnngangaagacaaggtcaacancctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggtgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggcnacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttgncccggcagctagaggaaaaggaggcgctaatctcgcagctnacccgngggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtgnaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggctgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggatgctgacctgtcccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggcggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactctg

SEQ ID NO: 731257 - DNA, 1373 bp, Homo sapiens
caggcagtgcaggagtatggttgagatgctaccaactgccattctgctggtcttggcagtgtccgtggttgctaaagataacgccacgtgtgatggcccctgtgggttacggttcaggcaaaacccacagggtggtgtccgcatcgtcggcgggaaggctgcacagcatggggcctggccctggatggtcagcctccagatcttcacgtacaacagccacaggtaccacacatgtggaggcagcttgctgaattcacgatgggtgctcactgctgctcactgcttcgtcggcaaaaataatgtgcatgactggagactggttttcggagcaaaggaaattacatatgggaacaataaaccagtaaaggcgcctgtgcaagagagatatgtggagaaaatcatcattcatgaaaaatacaactctgcgacagagggaaatgacattgccctcgtggagatcacccctcccatttcgtgtgggcgcttcattgggccgggctgcctgccccacttgaaggcaggcctccccagaggctcccagagctgctgggtggccggctggggatatatagaagagaaagcccccaggccatcatctatactgatggaggcacgtgtggatctcatcgacctggacttgtgtaactcgacccagtggtacaatgggcgcgttcagccaaccaatgtgtgcgcggggtatcctgtaggcaagatcgacacctgccagggagacagcggcgggcctctcatgtgcaaagacagcaaggaaagcgcctatgtggtcgtgggaatcacaagctggggggtaggctgtgcccgtgccaagcgccccggaatctacacggccacctggccttatctgaactggatcgcctccaagattggttctaacgctttgcgtatgattcaatcggccacccctccaccgcccaccactcgaccgcccccgattcgaccccccttctcccaccctatctctgctcaccttccttggtatttccaaccgccccctcgaccacttccaccccgaccaccggcagcccagccccgacccccaccttcacccccgcccccacccccacctccagcctcacctttacccccacccccacccccacccccacctacaccctcatctaccacaaaacttccccaaggactttcttttgccaagcgcctacagcagctcatagaggtcttgaaggggaagacctattccgacggaaagaaccattatgacatggagaccacagagctcccagaactgacctcgacctcctgatctgacctggttctcaacagacccagtgagcccttcactcctgagaaaaaggaaagatgaaataaataaataaacatatatatatagatat

SEQ ID NO: 731258 - DNA, 718 bp, Homo sapiens
caggcagtgcaggagtatggttgagatgctaccaactgccattctgctggtcttggcagtgtccgtggttgctaaagataacgccacgtgtgatggcccctgtgggttacggttcaggcaaaacccacagggtggtgtccgcatcgtcggcgggaaggctgcacagcatggggcctggccctggatggtcagcctccagatcttcacgtacaacagccacaggtaccacacatgtggaggcagcttgctgaattcacgatgggtgctcactgctgctcactgcttcgtcggcaaaaataatgtgcatgactggagactggttttcggagcaaaggaaattacatatgggaacaataaaccagtaaaggcgcctgtgcaagagagatatgtggagaaaatcatcattcatgaaaaatacaactctgcgacagagggaaatgacattgccctcgtggagatcacccctcccatttcgtgtgggcgcttcattgggccgggctgcctgccccacttgaaggcaggcctccccagaggctcccagagctgctgggtggccggctggggatatatagaagagaaaggcttcctggagtgtccggcaggtacctctccattcaagacgggtgtagctgtcgctctagagctctgtccataaccaagctgtctctctctcccctggctcccagaagatctcttgcccatccaacactacctgata

SEQ ID NO: 731259 - DNA, 791 bp, Homo sapiens
ggagacagcggcgggcctctcatgtgcaaagacagcaaggaaagcgcctatgtggtcgtgggaatcacaagctggggggtaggctgtgcccgtgccaagcgccccggaatctacacggccacctggccttatctgaactggatcgcctccaagattggttctaacgctttgcgtatgattcaatcggccacccctccaccgcccaccactcgaccgcccccgattcgaccccccttctcccaccctatctctgctcaccttccttggtatttccaaccgccccctcgaccacttccaccccgaccaccggcagcccagccccgacccccaccttcacccccgcccccacccccacctccagcctcacctttacccccacccccacccccacccccacctacaccctcatctaccacaaaacttccccaaggactttcttttgccaagcgcctacagcagctcatagaggtcttgaaggggaagacctattccgacggaaagaaccattatgacatggagaccacagagctcccagaactgacctcgacctcctgatctgacctggttctcaacagacccagtgagcccttcactcctgagaaaaaggaaagatgaaataaataaataaacatatatatatagatatacacacacacatatctgtatgtatacatgcatatacatcaagagatgctttctggacttcttcctatcccccctcccaacccaaatttcccctataaaatctaccctctctccttcaccctacaataaggcggaattgcttgtac

SEQ ID NO: 731260 - DNA, 2141 bp, Homo sapiens
gtccctagcaggcaagtcttctggaggggagaggctcctggcagccgtgaagcccagcgtgtgaggtcccaggtaagagagagggttggccacaaaggactccagcaggtgaggccccaggaaacctgccatggcctcctggtgagctgtcctcatccactgctcgctgcctctccagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaattccagcactttgggaggctgaggtaggaggattgattgaggccaagagttaaagaccagcctggtcaatatagcaagaccacgtctctaaataaaaaataataggccggccagca

SEQ ID NO: 731261 - DNA, 2583 bp, Homo sapiens
gttcccacttcctcccgccccaggaaacctgccatggcctcctggtgagctgtcctcatccactgctcgctgcctctccagatcttcagttgcttcaggccactttgaatgtatatgagccggtcgtaggggatatcgatggcttagcttgggctcagaggcctgaaaatcgcccccaccaatcacctgtttcccccaatctaccctcctgaaggtcactgacaaagacttcattgtctcctaggagaggctgccatatatcagggctgacgtaattccatcttaatatcagttacattataaaaatttacctcgtgcctgaggccccagagcccaagggtgcaaagcagtaattagtcaaagttcaacttcccctcccactctgggctcaggctgtccctgagggcctgtgttttgagtctctttccagaaccttggtgtgaacttaggtcttggcgtcgggatcccttttcgtcacactcaggtgacctacaggctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaattccagcactttgggaggctgaggtaggaggattgattgaggccaagagttaaagaccagcctggtcaatatagcaagaccacgtctctaaataaaaaataataggccggccagca

SEQ ID NO: 731262 - DNA, 2180 bp, Homo sapiens
gttcccacttcctcccgccccaggaaacctgccatggcctcctggtgagctgtcctcatccactgctcgctgcctctccaggtgacctacaggctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaattccagcactttgggaggctgaggtaggaggattgattgaggccaagagttaaagaccagcctggtcaatatagcaagaccacgtctctaaataaaaaataataggccggccagca

SEQ ID NO: 731263 - DNA, 2234 bp, Homo sapiens
gttcccacttcctcccgccccaggaaacctgccatggcctcctggtgagctgtcctcatccactgctcgctgcctctccagaaccttggtgtgaacttaggtcttggcgtcgggatcccttttcgtcacactcaggtgacctacaggctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaattccagcactttgggaggctgaggtaggaggattgattgaggccaagagttaaagaccagcctggtcaatatagcaagaccacgtctctaaataaaaaataataggccggccagca

SEQ ID NO: 731264 - DNA, 2077 bp, Homo sapiens; identical to SEQ ID NO: 704552

SEQ ID NO: 731265 - DNA, 3320 bp, Homo sapiens; identical to SEQ ID NO: 47600

SEQ ID NO: 731266 - DNA, 3194 bp, Homo sapiens; identical to SEQ ID NO: 47601

SEQ ID NO: 731267 - DNA, 1165 bp, Homo sapiens; identical to SEQ ID NO: 58007

SEQ ID NO: 731268 - DNA, 2577 bp, Homo sapiens
cggcaacaagtcctgtttttataagagagcgaggaggacacttctcagaaggggttgttttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagtcttggtccgcgccctcctcccgggtctgtgccgggacccgggacccgggagccgtcgcaggtctcggtccaaggggccccttttctcggaagggcggcggccaagagcggggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttggggatccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatggggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagtggtgctgtcccaggtggcttccagatgaacccaactgtggagatgatgcagttggcccaacctcactgacggtggaaaaatgtttgccagggtccagaaactttttttggtttatttctcatacagtgtattggcaactttggcacaccagaatttataaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcacaataaatgcaatatgcaaaatgtgattcgtccagttattagtgaagcccctccttttgtgagtatttactgtttattg

SEQ ID NO: 731269 - DNA, 2484 bp, Homo sapiens
cggcaacaagtcctgtttttataagagagcgaggaggacacttctcagaaggggttgttttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagggcggcggccaagagcggggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttggggatccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatggggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagtggtgctgtcccaggtggcttccagatgaacccaactgtggagatgatgcagttggcccaacctcactgacggtggaaaaatgtttgccagggtccagaaactttttttggtttatttctcatacagtgtattggcaactttggcacaccagaatttataaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcacaataaatgcaatatgcaaaatgtgattcgtccagttattagtgaagcccctccttttgtgagtatttactgtttattg

SEQ ID NO: 731270 - DNA, 1672 bp, Homo sapiens; identical to SEQ ID NO: 58011

SEQ ID NO: 731271 - DNA, 2384 bp, Homo sapiens
cggcaacaagtcctgtttttataagagagcgaggaggacacttctcagaaggggttgttttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagtcttggtccgcgccctcctcccgggtctgtgccgggacccgggacccgggagccgtcgcaggtctcggtccaaggggccccttttctcggaagggcggcggccaagagcggggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgaccggagccgcaggcgcccagttgcgtctacatccaccccgactcgcccaacttcggggcccactggatgaaggctcccgtctccttcagcaaagtcaagctccccaacaagctcaacggaggggcccagatcatgctgaactccttgcataagtatgagcctcgaatccacatagtgagagttggggatccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatggggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagtggtgctgtcccaggtggcttccagatgaacccaactgtggagatgatgcagttggcccaacctcactgacggtggaaaaatgtttgccagggtccagaaactttttttggtttatttctcatacagtgtattggcaactttggcacaccagaatttataaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcacaataaatgcaatatgcaaaatgtgattcgtccagttattagtgaagcccctccttttgtgagtatttactgtttattg

SEQ ID NO: 731272 - DNA, 1482 bp, Homo sapiens; identical to SEQ ID NO: 51987

SEQ ID NO: 731273 - DNA, 458 bp, Homo sapiens; identical to SEQ ID NO: 51986

SEQ ID NO: 731274 - DNA, 1649 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731275 - DNA, 745 bp, Homo sapiens; identical to SEQ ID NO: 450653
  misc_feature (692)..(692): n is a, c, g, or t
  misc_feature (709)..(709): n is a, c, g, or t
  misc_feature (714)..(714): n is a, c, g, or t
  misc_feature (718)..(718): n is a, c, g, or t
  misc_feature (729)..(729): n is a, c, g, or t

SEQ ID NO: 731276 - DNA, 694 bp, Homo sapiens
ggaaggcaagagatctaggacttctagcccctgaactttcagccgaatacatcttttccaaaggagtgaattcaggcccttgtatcactggcagcaggacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggttgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731277 - DNA, 594 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaactgaatcagccttgtctggaaccagatctacacctggactgcccaggtctataagccaataaagcccctgtttacttg

SEQ ID NO: 731278 - DNA, 1167 bp, Homo sapiens; identical to SEQ ID NO: 450673

SEQ ID NO: 731279 - DNA, 2246 bp, Homo sapiens; identical to SEQ ID NO: 450679

SEQ ID NO: 731280 - DNA, 2192 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731281 - DNA, 1531 bp, Homo sapiens; identical to SEQ ID NO: 450685

SEQ ID NO: 731282 - DNA, 1285 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731283 - DNA, 1882 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731284 - DNA, 1828 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731285 - DNA, 2073 bp, Homo sapiens; identical to SEQ ID NO: 450655
  misc_feature (2020)..(2020): n is a, c, g, or t
  misc_feature (2037)..(2037): n is a, c, g, or t
  misc_feature (2042)..(2042): n is a, c, g, or t
  misc_feature (2046)..(2046): n is a, c, g, or t
  misc_feature (2057)..(2057): n is a, c, g, or t

SEQ ID NO: 731286 - DNA, 2019 bp, Homo sapiens
  misc_feature (1966)..(1966): n is a, c, g, or t
  misc_feature (1983)..(1983): n is a, c, g, or t
  misc_feature (1988)..(1988): n is a, c, g, or t
  misc_feature (1992)..(1992): n is a, c, g, or t
  misc_feature (2003)..(2003): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731287 - DNA, 1130 bp, Homo sapiens; identical to SEQ ID NO: 450674

SEQ ID NO: 731288 - DNA, 1709 bp, Homo sapiens
  misc_feature (1656)..(1656): n is a, c, g, or t
  misc_feature (1673)..(1673): n is a, c, g, or t
  misc_feature (1678)..(1678): n is a, c, g, or t
  misc_feature (1682)..(1682): n is a, c, g, or t
  misc_feature (1693)..(1693): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731289 - DNA, 1655 bp, Homo sapiens
  misc_feature (1602)..(1602): n is a, c, g, or t
  misc_feature (1619)..(1619): n is a, c, g, or t
  misc_feature (1624)..(1624): n is a, c, g, or t
  misc_feature (1628)..(1628): n is a, c, g, or t
  misc_feature (1639)..(1639): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731290 - DNA, 1296 bp, Homo sapiens
ggaaggcaagagatctaggacttctagcccctgaactttcagccgaatacatcttttccaaaggaaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731291 - DNA, 1123 bp, Homo sapiens
  misc_feature (1070)..(1070): n is a, c, g, or t
  misc_feature (1087)..(1087): n is a, c, g, or t
  misc_feature (1092)..(1092): n is a, c, g, or t
  misc_feature (1096)..(1096): n is a, c, g, or t
  misc_feature (1107)..(1107): n is a, c, g, or t
ggaaggcaagagatctaggacttctagcccctgaactttcagccgaatacatcttttccaaaggaaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731292 - DNA, 1050 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731293 - DNA, 1647 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731294 - DNA, 1474 bp, Homo sapiens
  misc_feature (1421)..(1421): n is a, c, g, or t
  misc_feature (1438)..(1438): n is a, c, g, or t
  misc_feature (1443)..(1443): n is a, c, g, or t
  misc_feature (1447)..(1447): n is a, c, g, or t
  misc_feature (1458)..(1458): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731295 - DNA, 1459 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731296 - DNA, 2056 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731297 - DNA, 1883 bp, Homo sapiens
  misc_feature (1830)..(1830): n is a, c, g, or t
  misc_feature (1847)..(1847): n is a, c, g, or t
  misc_feature (1852)..(1852): n is a, c, g, or t
  misc_feature (1856)..(1856): n is a, c, g, or t
  misc_feature (1867)..(1867): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731298 - DNA, 2002 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731299 - DNA, 1829 bp, Homo sapiens
  misc_feature (1776)..(1776): n is a, c, g, or t
  misc_feature (1793)..(1793): n is a, c, g, or t
  misc_feature (1798)..(1798): n is a, c, g, or t
  misc_feature (1802)..(1802): n is a, c, g, or t
  misc_feature (1813)..(1813): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731300 - DNA, 1835 bp, Homo sapiens; identical to SEQ ID NO: 450684

SEQ ID NO: 731301 - DNA, 955 bp, Homo sapiens; identical to SEQ ID NO: 450677

SEQ ID NO: 731302 - DNA, 1471 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataactccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731303 - DNA, 1353 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaacaataccacgcagtccctccactttagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731304 - DNA, 1180 bp, Homo sapiens
  misc_feature (1127)..(1127): n is a, c, g, or t
  misc_feature (1144)..(1144): n is a, c, g, or t
  misc_feature (1149)..(1149): n is a, c, g, or t
  misc_feature (1153)..(1153): n is a, c, g, or t
  misc_feature (1164)..(1164): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaacaataccacgcagtccctccactttagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731305 - DNA, 908 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaagagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731306 - DNA, 1505 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaagagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731307 - DNA, 1332 bp, Homo sapiens
  misc_feature (1279)..(1279): n is a, c, g, or t
  misc_feature (1296)..(1296): n is a, c, g, or t
  misc_feature (1301)..(1301): n is a, c, g, or t
  misc_feature (1305)..(1305): n is a, c, g, or t
  misc_feature (1316)..(1316): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaagagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731308 - DNA, 1388 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731309 - DNA, 1215 bp, Homo sapiens
  misc_feature (1162)..(1162): n is a, c, g, or t
  misc_feature (1179)..(1179): n is a, c, g, or t
  misc_feature (1184)..(1184): n is a, c, g, or t
  misc_feature (1188)..(1188): n is a, c, g, or t
  misc_feature (1199)..(1199): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731310 - DNA, 1331 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731311 - DNA, 1492 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731312 - DNA, 1319 bp, Homo sapiens
  misc_feature (1266)..(1266): n is a, c, g, or t
  misc_feature (1283)..(1283): n is a, c, g, or t
  misc_feature (1288)..(1288): n is a, c, g, or t
  misc_feature (1292)..(1292): n is a, c, g, or t
  misc_feature (1303)..(1303): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731313 - DNA, 1435 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731314 - DNA, 1590 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731315 - DNA, 1284 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731316 - DNA, 1881 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731317 - DNA, 1708 bp, Homo sapiens
  misc_feature (1655)..(1655): n is a, c, g, or t
  misc_feature (1672)..(1672): n is a, c, g, or t
  misc_feature (1677)..(1677): n is a, c, g, or t
  misc_feature (1681)..(1681): n is a, c, g, or t
  misc_feature (1692)..(1692): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731318 - DNA, 1824 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731319 - DNA, 1827 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731320 - DNA, 1654 bp, Homo sapiens
  misc_feature (1601)..(1601): n is a, c, g, or t
  misc_feature (1618)..(1618): n is a, c, g, or t
  misc_feature (1623)..(1623): n is a, c, g, or t
  misc_feature (1627)..(1627): n is a, c, g, or t
  misc_feature (1638)..(1638): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731321 - DNA, 1470 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataactccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731322 - DNA, 1142 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731323 - DNA, 1739 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731324 - DNA, 1566 bp, Homo sapiens
  misc_feature (1513)..(1513): n is a, c, g, or t
  misc_feature (1530)..(1530): n is a, c, g, or t
  misc_feature (1535)..(1535): n is a, c, g, or t
  misc_feature (1539)..(1539): n is a, c, g, or t
  misc_feature (1550)..(1550): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731325 - DNA, 1682 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagcctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731326 - DNA, 1185 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731327 - DNA, 1782 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731328 - DNA, 1609 bp, Homo sapiens
  misc_feature (1556)..(1556): n is a, c, g, or t
  misc_feature (1573)..(1573): n is a, c, g, or t
  misc_feature (1578)..(1578): n is a, c, g, or t
  misc_feature (1582)..(1582): n is a, c, g, or t
  misc_feature (1593)..(1593): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731329 - DNA, 1725 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731330 - DNA, 1137 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731331 - DNA, 1734 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731332 - DNA, 1561 bp, Homo sapiens
  misc_feature (1508)..(1508): n is a, c, g, or t
  misc_feature (1525)..(1525): n is a, c, g, or t
  misc_feature (1530)..(1530): n is a, c, g, or t
  misc_feature (1534)..(1534): n is a, c, g, or t
  misc_feature (1545)..(1545): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731333 - DNA, 1677 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731334 - DNA, 1999 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731335 - DNA, 2189 bp, Homo sapiens; identical to SEQ ID NO: 450659

SEQ ID NO: 731336 - DNA, 1163 bp, Homo sapiens; identical to SEQ ID NO: 450671

SEQ ID NO: 731337 - DNA, 968 bp, Homo sapiens; identical to SEQ ID NO: 450676

SEQ ID NO: 731338 - DNA, 1113 bp, Homo sapiens; identical to SEQ ID NO: 450687

SEQ ID NO: 731339 - DNA, 1598 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731340 - DNA, 2195 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731341 - DNA, 2022 bp, Homo sapiens
  misc_feature (1969)..(1969): n is a, c, g, or t
  misc_feature (1986)..(1986): n is a, c, g, or t
  misc_feature (1991)..(1991): n is a, c, g, or t
  misc_feature (1995)..(1995): n is a, c, g, or t
  misc_feature (2006)..(2006): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731342 - DNA, 2138 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731343 - DNA, 2141 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731344 - DNA, 1968 bp, Homo sapiens
  misc_feature (1915)..(1915): n is a, c, g, or t
  misc_feature (1932)..(1932): n is a, c, g, or t
  misc_feature (1937)..(1937): n is a, c, g, or t
  misc_feature (1941)..(1941): n is a, c, g, or t
  misc_feature (1952)..(1952): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731345 - DNA, 1784 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataactccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731346 - DNA, 1480 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggttgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731347 - DNA, 1604 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaacctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731348 - DNA, 2201 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaacctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731349 - DNA, 2028 bp, Homo sapiens
  misc_feature (1975)..(1975): n is a, c, g, or t
  misc_feature (1992)..(1992): n is a, c, g, or t
  misc_feature (1997)..(1997): n is a, c, g, or t
  misc_feature (2001)..(2001): n is a, c, g, or t
  misc_feature (2012)..(2012): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaacctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731350 - DNA, 2144 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaacctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731351 - DNA, 1626 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtc

SEQ ID NO: 731352 - DNA, 2223 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731353 - DNA, 2050 bp, Homo sapiens
  misc_feature (1997)..(1997): n is a, c, g, or t
  misc_feature (2014)..(2014): n is a, c, g, or t
  misc_feature (2019)..(2019): n is a, c, g, or t
  misc_feature (2023)..(2023): n is a, c, g, or t
  misc_feature (2034)..(2034): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731354 - DNA, 2166 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731355 - DNA, 2169 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731356 - DNA, 1996 bp, Homo sapiens
  misc_feature (1943)..(1943): n is a, c, g, or t
  misc_feature (1960)..(1960): n is a, c, g, or t
  misc_feature (1965)..(1965): n is a, c, g, or t
  misc_feature (1969)..(1969): n is a, c, g, or t
  misc_feature (1980)..(1980): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataacacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731357 - DNA, 1812 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataactccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731358 - DNA, 1508 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatatgagattaacaccatctatcttggcgggcccttcagtcctaatgtcctgaactggcgggcactgaagtatgaagtgcaaggcgaagtgttcaccaaaccccagctgtggccctgaggcccagctgtgggttgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731359 - DNA, 1556 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731360 - DNA, 1383 bp, Homo sapiens
  misc_feature (1330)..(1330): n is a, c, g, or t
  misc_feature (1347)..(1347): n is a, c, g, or t
  misc_feature (1352)..(1352): n is a, c, g, or t
  misc_feature (1356)..(1356): n is a, c, g, or t
  misc_feature (1367)..(1367): n is a, c, g, or t
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgcaanaaaaaaaaaaaaaaaantttgngggngctgggcccgnaaagttttaaaaccat

SEQ ID NO: 731361 - DNA, 1825 bp, Homo sapiens
ggaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttcctggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgtgatgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtac

SEQ ID NO: 731362 - DNA, 1036 bp, Homo sapiens; identical to SEQ ID NO: 450675

SEQ ID NO: 731363 - DNA, 194 bp, Homo sapiens
tcagcctctctggtagctgggattacaggactaccgtgaggatggattggacattacaccacactggaaaagtgaaacatctcattcagttggtgatcttcctgtcatgaaagttgcttgacagctctaattacgaattgaacacattaaacacctggtgaaattatcaattaaaaacatctagtcaccataaa

SEQ ID NO: 731364 - DNA, 2103 bp, Homo sapiens; identical to SEQ ID NO: 52411

SEQ ID NO: 731365 - DNA, 2089 bp, Homo sapiens; identical to SEQ ID NO: 683490

SEQ ID NO: 731366 - DNA, 343 bp, Homo sapiens; identical to SEQ ID NO: 683493

SEQ ID NO: 731367 - DNA, 1630 bp, Homo sapiens
ttggggtccattgcaacccgaggcgagactagagttcccaagcgagaagggaagaggcagtgggtgcacgtggaaggcggacagagggctggaaacaagacgctccagaatcaggagcttcccctcaggaaatagcatcctgtgtccccgcactgcagttgtctggtctctccagcagtttggtacttccggctgctgcaatgcgtgtggtggtgattggagcaggagtcatcgggctgtccaccgccctctgcatccatgagcgctaccactcagtcctgcagccactgcacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgca

SEQ ID NO: 731368 - DNA, 1365 bp, Homo sapiens
ggcggacagagggctggaaacaagacgctccagaatcaggagcttcccctcaggaaatagcatcctgtgtccccgcactgcagttgtctggtctctccagcagtttggtacttccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcagcaaagacaactatctgatgttgtttaacccagtgcttgctaaacctatctggctatggaactcttttgcccagagcacccatgaatgccatgacacaaatctgagaaaatgctggaacagattttgt

SEQ ID NO: 731369 - DNA, 1311 bp, Homo sapiens
ggcggacagagggctggaaacaagacgctccagaatcaggagcttcccctcaggaaatagcatcctgtgtccccgcactgcagttgtctggtctctccagcagtttggtacttccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagtgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcagcaaagacaactatctgatgttgtttaacccagtgcttgctaaacctatctggctatggaactcttttgcccagagcacccatgaatgccatgacacaaatctgagaaaatgctggaacagattttgt

SEQ ID NO: 731370 - DNA, 1183 bp, Homo sapiens
ggcggacagagggctggaaacaagacgctccagaatcaggagcttcccctcaggaaatagcatcctgtgtccccgcactgcagttgtctggtctctccagcagtttggtacttccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagtgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgca

SEQ ID NO: 731371 - DNA, 1237 bp, Homo sapiens
ggcggacagagggctggaaacaagacgctccagaatcaggagcttcccctcaggaaatagcatcctgtgtccccgcactgcagttgtctggtctctccagcagtttggtacttccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgca

SEQ ID NO: 731372 - DNA, 1726 bp, Homo sapiens; identical to SEQ ID NO: 446519

SEQ ID NO: 731373 - DNA, 1950 bp, Homo sapiens; identical to SEQ ID NO: 446515

SEQ ID NO: 731374 - DNA, 627 bp, Homo sapiens
gccccaaccatcctgaagctacaggtgctccctcctggaatctccaatggatttcagtcgcagaagcttccacagaagcctgagctcctccttgcaggcccctgtagtcagtacagtgggcatgcagcgcctcgggacgacacccagcgtttatgggggtgctggaggccggggcatccgcatctccaactccagacacacggtgaactatgggagcgatctcacaggcggcggggacctgtttgttggcaatgagaaaatggccatgcagaacctaaatgaccgtctagcgagctacctagaaaaggtgcggaccctggagcagtccaactccaaacttgaagtgcaaatcaagcagtggtacgaaaccaacgccccgagggctggtcgcgactacagtgcatattacagacaaattgaagagctgcgaagtcagattaaggatgctcaactgcaaaatgctcggtgtgtcctgcaaattgataatgctaaactggctgctgaggacttcagactgaagtaggttccctaatacgtggcaaaagtttctgaaaaagaattcctttagtagtccttccagatactcagctttccatatcattgttgataaaggaagcacggttcaat

SEQ ID NO: 731375 - DNA, 1489 bp, Homo sapiens; identical to SEQ ID NO: 446520

SEQ ID NO: 731376 - DNA, 310 bp, Homo sapiens; identical to SEQ ID NO: 446518

SEQ ID NO: 731377 - DNA, 1601 bp, Homo sapiens; identical to SEQ ID NO: 415203

SEQ ID NO: 731378 - DNA, 700 bp, Homo sapiens
gcccgtcacacataagagcaaggaaactctctgaatgcccagcatactacaatgcacttgacccagagtttacaaccctctagcacaaaggtgcatctcaactcatgtgcctgtcagaagtgcacgccctgccaacgggaggcagaaatctcacctatgctccagggcaggtgggaagggcggctgggaacccctgtacccaggatgccttagaggaagggaaggcctccccaaagacctctacctacccaatcaagggcaggcccttattttcccttcttgggttccccagaggccgcagtaccctagcagaaacagttactgaggtggctgacagggtgtcccttcccaaatcaccctcccaccttaggcctacagccccacttcaatggcgtttgtgtgtctgtgtctgtacacgcctgtgctctggactcgctgtgcagggtccggctccgaggcgctggtcggcagtccgaacggagggagcgagacccccaagagcaacggcggcagtggtgggggcggctcgcaaggcaccctggcgtgcagcgccagtgaccagatgcgtcgttaccgcaccgccttcacccgagagcagattgcgcggctggagaaggaattctaccgggagaactacgtatccaggccgcggagatgtgagctggcggccgccctaaacctgccggaaaccaccatcaag

SEQ ID NO: 731379 - DNA, 883 bp, Homo sapiens
agctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagatgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggc

SEQ ID NO: 731380 - DNA, 914 bp, Homo sapiens
  misc_feature (4)..(4): n is a, c, g, or t
  misc_feature (6)..(9): n is a, c, g, or t
  misc_feature (14)..(15): n is a, c, g, or t
ggcncnnnngaggnnagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctcctttgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatg

SEQ ID NO: 731381 - DNA, 739 bp, Homo sapiens
tattcccagcagagcagtcagccctacggacagcagagttacagtggttatagccagtccacggacacttcaggctatggccagagcagctattcttcttatggccagagccagaacatgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggc

SEQ ID NO: 731382 - DNA, 346 bp, Homo sapiens
tggtgactggaagtgtcctaatcccacctgtgagaatatgaacttctcttggaggaatgaatgcaaccagtgtaaggcccctaaaccagatggcccaggagggggaccaggtggctctcacatgggggtgttcaagaaggaagtgtatcttcatacatcaccacacctgaaagcagatgtgcttttccagactgatccaactgcagagatggcagctgagtcattgcctttctcctttgggacactgtccagctgggagctggaagcctggtatgaggacctgcaagaggtcctgtcttcagatgaaaatgggggtacctatgtttcacctcctggaaatgaagag

SEQ ID NO: 731383 - DNA, 1367 bp, Homo sapiens; identical to SEQ ID NO: 24958
  misc_feature (54)..(54): n is a, c, g, or t
  misc_feature (56)..(56): n is a, c, g, or t
  misc_feature (60)..(62): n is a, c, g, or t
  misc_feature (64)..(64): n is a, c, g, or t
  misc_feature (1334)..(1335): n is a, c, g, or t
  misc_feature (1339)..(1343): n is a, c, g, or t
  misc_feature (1347)..(1347): n is a, c, g, or t
  misc_feature (1352)..(1352): n is a, c, g, or t
  misc_feature (1358)..(1358): n is a, c, g, or t
  misc_feature (1360)..(1360): n is a, c, g, or t
  misc_feature (1362)..(1362): n is a, c, g, or t
  misc_feature (1367)..(1367): n is a, c, g, or t

SEQ ID NO: 731384 - DNA, 2872 bp, Homo sapiens; identical to SEQ ID NO: 24960
  misc_feature (54)..(54): n is a, c, g, or t
  misc_feature (56)..(56): n is a, c, g, or t
  misc_feature (60)..(62): n is a, c, g, or t
  misc_feature (64)..(64): n is a, c, g, or t

SEQ ID NO: 731385 - DNA, 1958 bp, Homo sapiens
  misc_feature (1340)..(1340): n is a, c, g, or t
tgcgcctgcgccttgtgctcctgactggctgcgctccctgcccccaacaccgccgtggcctgggaaacggtcccagagctgctgagccgacctactggtgtcatggcagccccaaagacagcagctgtggggccgttggtgggagcggtggtccaggcaccaactccactcgctttctggttttcaattcaaaaacagcggaactacttagtcatcacaaagtggaattaacacaagagttcccaaaagaaggatgggtggaacaagaccctaaagaaattcttcagtctgtctacgagtgtatagcgagaacgtgtgagaaacttgacgaactgaatattgatatatccaacataaaagctgttggtgtcagcaatcagagggaaaccactgtaatctgggacaagttaacaggagagcctctctacaatgctgtggtgtggcttgatctaagaacccagactactgttgaggatcttagtaaaaaaattccaggaaatagtaacttcgtcaagtctaagacaggccttccactcagcacttacttcagtgcagtaaaacttcgttggatgcttgacaatgtgagaaacgtccaaaaggctgttgaagaaggtagagctctttttggtaccattgattcatggcttatctggagtttgacaggaggagttaatggaggcgtgcattgtacagatgtaacaaatgcaagtaggacaatgctttttaatatccattctttggaatgggataaagagctctgtgacttttttgaaattccaatggaccttcttccaaatgtcttcagttcttctgagatctatggcctaattaaaactggagccctggaaggtgtgccaatatctgggtgtttgggggaccaatgtgctgcattagtaggacaaatgtgcttccaggagggacaagccaaaaacacctatggaacaggttgcttcttactgtgtaatacgggtcgtaaatgtgtgttttctgaacatggccttttgaccacagtagcttacaaactaggcagagagaagccagcatattatgcactggaaggttctgttgctatagcaggtgctgttattcgttggctaagagacaatcttggaattatagagacctcaggagacattgaaagacttgctaaagaagtaggaacttcttatggctgttactttgtcccagccttttcagggttatatgcaccttattgggagcccagtgcaagagggatactctgtggcctcactcagtttaccaataaatgtcatattgcttttgctgcattagaagctgtttgtttccaaacccgagagattttggaagccatgaaccgngactgtggaattccacttcgtcatttgcaggtagatggaggaatgaccaacaacaaagttcttatgcagctacaagcagatattcttcatattccagtaataaaaccctttatgcctgaaacaactgcactaggagctgccatggcagcaggggctgcagagggagtaagcgtttggagccttgaaccccaggctttgtcagttctcaggatggaacgatttgaaccacagatccaggccacagaaagtgaaattcgttatgccacatggaagaaagccgtaatgaagtcaatgggttgggttaccagtcagtctcctgaaggtggtgatccttctatcttctctagtctgcctttgggattttttatagtgagtagcatggtaatgctaattggagcaagatatatctcgggtgtgccataataataccagctatggagtcccaagatgtaaacattttacataatgaaagcatatagcagttctgcctcttaatataatgacactattatagactctgattttgtttataaaccacttgctacatgacccatgaaaaccctagacttgtgacctgaaataaagaaaatacgttagaagagcactgtaaaaaaaaaa

SEQ ID NO: 731386 - DNA, 1374 bp, Homo sapiens; identical to SEQ ID NO: 446221

SEQ ID NO: 731387 - DNA, 416 bp, Homo sapiens
tcggtacccgtatctctaacattagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggcatcaacaaa

SEQ ID NO: 731388 - DNA, 607 bp, Homo sapiens; identical to SEQ ID NO: 446222

SEQ ID NO: 731389 - DNA, 583 bp, Homo sapiens; identical to SEQ ID NO: 446225

SEQ ID NO: 731390 - DNA, 448 bp, Homo sapiens; identical to SEQ ID NO: 446224

SEQ ID NO: 731391 - DNA, 1166 bp, Homo sapiens
  misc_feature (3)..(4): n is a, c, g, or t
  misc_feature (7)..(7): n is a, c, g, or t
  misc_feature (14)..(14): n is a, c, g, or t
  misc_feature (21)..(21): n is a, c, g, or t
  misc_feature (36)..(36): n is a, c, g, or t
gannaanaaaaacngggcgantggggaccgggcccnttttcgacccacgcgtccgcacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttc

SEQ ID NO: 731392 - DNA, 1157 bp, Homo sapiens
cggacgcgtgggcggacgcgttgtggtcggcccacgcgtccgcaaagacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttc

SEQ ID NO: 731393 - DNA, 1090 bp, Homo sapiens
  misc_feature (3)..(4): n is a, c, g, or t
  misc_feature (7)..(7): n is a, c, g, or t
  misc_feature (14)..(14): n is a, c, g, or t
  misc_feature (21)..(21): n is a, c, g, or t
  misc_feature (36)..(36): n is a, c, g, or t
gannaanaaaaacngggcgantggggaccgggcccnttttcgacccacgcgtccgcacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgtttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttc

SEQ ID NO: 731394 - DNA, 1246 bp, Homo sapiens
gtcatttgtaacaaaaactcattatttacagatgagaaatttatattgtcagcgtaatatctgtgaggctaaacagagctggagagtatataaaagcagtgcgccttggtgcagaagtacagagcttaggacacagacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttc

SEQ ID NO: 731395 - DNA, 765 bp, Homo sapiens
  misc_feature (3)..(4): n is a, c, g, or t
  misc_feature (7)..(7): n is a, c, g, or t
  misc_feature (14)..(14): n is a, c, g, or t
  misc_feature (21)..(21): n is a, c, g, or t
  misc_feature (36)..(36): n is a, c, g, or t
gannaanaaaaacngggcgantggggaccgggcccnttttcgacccacgcgtccgcatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttc

SEQ ID NO: 731396 - DNA, 1135 bp, Homo sapiens
cggacgcgtgggcggacgcgttgtggtcggcccacgcgtccgcaaagacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttc

SEQ ID NO: 731397 - DNA, 1224 bp, Homo sapiens
gtcatttgtaacaaaaactcattatttacagatgagaaatttatattgtcagcgtaatatctgtgaggctaaacagagctggagagtatataaaagcagtgcgccttggtgcagaagtacagagcttaggacacagacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttc

SEQ ID NO: 731398 - DNA, 916 bp, Homo sapiens
  misc_feature (3)..(4): n is a, c, g, or t
  misc_feature (7)..(7): n is a, c, g, or t
  misc_feature (14)..(14): n is a, c, g, or t
  misc_feature (21)..(21): n is a, c, g, or t
  misc_feature (36)..(36): n is a, c, g, or t
gannaanaaaaacngggcgantggggaccgggcccnttttcgacccacgcgtccgcggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttc

SEQ ID NO: 731399 - DNA, 1144 bp, Homo sapiens
  misc_feature (3)..(4): n is a, c, g, or t
  misc_feature (7)..(7): n is a, c, g, or t
  misc_feature (14)..(14): n is a, c, g, or t
  misc_feature (21)..(21): n is a, c, g, or t
  misc_feature (36)..(36): n is a, c, g, or t
gannaanaaaaacngggcgantggggaccgggcccnttttcgacccacgcgtccgcacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttc

SEQ ID NO: 731400 - DNA, 1301 bp, Homo sapiens; identical to SEQ ID NO: 311693

SEQ ID NO: 731401 - DNA, 1123 bp, Homo sapiens; identical to SEQ ID NO: 311694

SEQ ID NO: 731402 - DNA, 1181 bp, Homo sapiens
tatcagccccctgggactccctggccccaacctgccacctcaccaaagctctgagccctgctagccttgaggcgcggaccctcccccatacctcccacagtatcccagcgcctcatgcccccaaccccaagccctgcccttcaccgcccggctgcactggcctctaggactcacagcagccagccccagctaggaacgggcaggacttggggcagctgaagctcacggtgactcagcagtgcccaactgaccaatctcccgcagctctcctgcccctgggggcccacgactcacctggtgggcctgggctcagcaaacagccctccctcccagtatttcatcaaggacagggaatatccctcccacacacaggccagctgctcaccctgccacctccatgtgacaagtttgacacctgtctacccagagccagtgactgtccctcccagcagcctccaaagggtccaaagtccaagctagctctggcctgtgtggcccccacataaataaattagtggggagggggcagacctgggggcccttgggtgccagagtgagacacagcaggacccttccccaaatactaggctcagagcaacctccagccttctccagcaggatctgctccctgtgtccttggacagcagatccacacaccacttccccacccacacacagtaccctgggctggttggacaacaggatggtgtgttaaggggttaagggagggtactgttgacaccagctatggccaatagctgggctgtcctgaggggtggctggggacagagtccagctcccttggatcagcccagaggattcaggataggacaaaggccctggctgtgcccaaaaagggtctacctcaggtggggttacaagcaaacctgggtgaccctcttgtccctaccagcagcttctcttgccccttccattcagggttccctggcaggggaagctgagagccatggctgaactatcagggacaaaggcccatgtccccacatccctgctccctccttcctcatccagcaccaaatctttgcttatgttccacagccagggcctgtgctgcagtcggggacaaggagcttccgtctggcaaggccggggcacaatttgcactcccctcagctagacgcacagactcagcaataaacctttgcatcaggctccagctg

SEQ ID NO: 731403 - DNA, 356 bp, Homo sapiens
caaaagagctaattccctctgagcctcctggagacacctgcaccccttcaggtgaaatgcaaggggtttacccgcctcaaataacccagtgcttgcggtaccagaggctcccacgaggtggcgatgacgctccgggatttcttcattgcagtctcacagcataataaaggctgcctgtgccggggtcttggggactcccctgtcccagaacagttgaggtcgttgagtcccctcgttggcttcctttcttcactttcctggcatttgcaaaccttgtgacttcaggatgtcaggacttaatttggatgggggggtgccggtgagtccgggaagagcaccatcgtcaagcagatgaa

SEQ ID NO: 731404 - DNA, 1013 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatc

SEQ ID NO: 731405 - DNA, 1738 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcaaacaaaaacaacaaacaaacaaaaaaaaaaaaacaaaaacaaaaaaaacaaaaaaaaaaaaaaaaaaaaaaaaaatgggggggggggggccggcgcggccagaaagaaattaaacaccgggggggggggggggcccaagaagcaaaccagtgtcacaccatcgtttccccagaaaaacatcggggtgaaagcaaggcgggggggggtcttccccaccaaaaaaaaagcgcgcgcgggggaacacccccagagggtctttcaaacacaccacacgaggaggcccgggcgcacacgggcggggtcccaaaaccagggagcgacccccagagcgggcgccggctaataaaaaatagccacccgcaccgcaggggacaccatcagactcacctgccacagcatcattactatgcaccatcactacacaatcacagtccgggtgcacagcaagagccaccgacaagtacatcatcaacagcagcagacctaagcacaaagcgctacccacacaccacccacacgaacaacaaccaccagcaacccaaccacccaacccagcacgcacaagcaccgacaagccaggaacgcaccaccctagacacgcaaaaaccacaccctagcagacccacaccacgccccaaccccaaccaaccaccacacccccaacttcaccatcaccccacccacgtgccccacggacgaaaagcacaccccagaacctacgaaa

SEQ ID NO: 731406 - DNA, 1153 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatccaaaaaaaaaaaacaaaaaatgttggggggcggccgaaaatttaaacatttgggggcggccaagtagaaagggaagggccaagaacgggcaagggtgttcccaaaaccgggggggaaaaaggtggaggtaagaaaagggg

SEQ ID NO: 731407 - DNA, 717 bp, Homo sapiens
gcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtaagaacctcaagatccccagaagctttctaacagcccaatcagagaaatgttcatagagcccacccatggaatttaatgccaaaggtgtctaatgacccagcctctgtcgagcatttgtacaggtggggaatacatttctacccattaattaaaagagtcaattgtcttgtgggtatagactggatttattcagaatgaggagaataggggtagaggtgacaaggggcaggttgggagaaagtacagcttacttgtgctaaaaatatttcctaaaaaggagactgtgcaaatgtagtatgcatctacttatttcagcagaatgcaaacaattttatgtaat

SEQ ID NO: 731408 - DNA, 1202 bp, Homo sapiens
  misc_feature (1047)..(1049): n is a, c, g, or t
  misc_feature (1052)..(1052): n is a, c, g, or t
  misc_feature (1059)..(1059): n is a, c, g, or t
  misc_feature (1062)..(1062): n is a, c, g, or t
  misc_feature (1064)..(1065): n is a, c, g, or t
  misc_feature (1072)..(1073): n is a, c, g, or t
  misc_feature (1080)..(1080): n is a, c, g, or t
  misc_feature (1085)..(1085): n is a, c, g, or t
  misc_feature (1096)..(1096): n is a, c, g, or t
  misc_feature (1098)..(1098): n is a, c, g, or t
  misc_feature (1106)..(1106): n is a, c, g, or t
  misc_feature (1113)..(1113): n is a, c, g, or t
  misc_feature (1129)..(1130): n is a, c, g, or t
  misc_feature (1133)..(1133): n is a, c, g, or t
  misc_feature (1136)..(1136): n is a, c, g, or t
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcaatctatgaacaaaaaaacaaaaaaaaaattggnnngcnggcccanaantnnaacattnnggcggcnccagnatgacaggcangncacaaacnggacagnggtcccaaaaccgggnncgncanaccggggcttggtcaggtgacaatccgcgcggtatggcagccccatctcttcctccctcccgctcc

SEQ ID NO: 731409 - DNA, 623 bp, Homo sapiens
gcagttactgagaactcataagacgaagctaaaatccctcttcggatccacagtcaaccgccctgaacacatcctgcaaaaagcccagagaaagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatctcattcaatcactg

SEQ ID NO: 731410 - DNA, 1334 bp, Homo sapiens
gcagttactgagaactcataagacgaagctaaaatccctcttcggatccacagtcaaccgccctgaacacatcctgcaaaaagcccagagaaagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcaaacaaaaacaacaaacaaacaaaaaaaaaaaaacaaaaacaaaaaaaacaaaaaaaaaaaaaaaaaaaaaaaaaatgggggggggggggccggcgcggccagaaagaaattaaacaccgggggggggggggggcccaagaagcaaaccagtgtcacaccatcgtttccccagaaaaacatcggggtgaaagcaaggcgggggggggtcttccccaccaaaaaaaaagcgcgcgcgggggaacacccccagagggtctttcaaacacaccacacgaggaggcccgggcgcacacgggcggggtcccaaaaccagggagcgacccccagagcgggcgccggctaataaaaaatagccacccgcaccgcaggggacaccatcagactcacctgccacagcatcattactatgcaccatcactacacaatcacagtccgggtgcacagcaagagccaccgacaagtacatcatcaacagcagcagacctaagcacaaagcgctacccacacaccacccacacgaacaacaaccaccagcaacccaaccacccaacccagcacgcacaagcaccgacaagccaggaacgcaccaccctagacacgcaaaaaccacaccctagcagacccacaccacgccccaaccccaaccaaccaccacacccccaacttcaccatcaccccacccacgtgccccacggacgaaaagcacaccccagaacctacgaaa

SEQ ID NO: 731411 - DNA, 629 bp, Homo sapiens
gcagttactgagaactcataagacgaagctaaaatccctcttcggatccacagtcaaccgccctgaacacatcctgcaaaaagcccagagaaagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatccaaaaaaaaaaaacaaaaaa

SEQ ID NO: 731412 - DNA, 609 bp, Homo sapiens
gcagttactgagaactcataagacgaagctaaaatccctcttcggatccacagtcaaccgccctgaacacatcctgcaaaaagcccagagaaagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatc

SEQ ID NO: 731413 - DNA, 1027 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatctcattcaatcactg

SEQ ID NO: 731414 - DNA, 2319 bp, Homo sapiens
  misc_feature (603)..(603): n is a, c, g, or t
  misc_feature (871)..(871): n is a, c, g, or t
gcagttactgagaactcataagacgaagctaaaatccctcttcggatccacagtcaaccgccctgaacacatcctgcaaaaagcccagagaaaggtaatatgaatgaaataattttgggggactttaattgaggagtaaaatatttgagaatatgaggaagattccaaagtctctgcatataccttaataagaactgagacaggcttttactcattctcttttcagcacttatgattgaattagaaggaagtctgtaaaatttggctgtgatcatagggtaagatgttatctaacagaagccagaaacccaatgtctcctgctgagatgcttgagtgcctgtcaggatctaaaaattttcctcaagaattactgtatgtcattggaaagacgttcttttgagtggcttccaggagccagacagagggcaagtagacattatgatattgttttattatccatttttaagtgatgtatagctatatcttcaagctggcccatgataaagtggttcacttgttcagctgaatgactatagcttctgattatcttttgaatagatgttctcatgcagacttgaatagtagcatggaatttcttgaangtcgttgttttcatttttcttctttaataaaatgctacaaaaatcaaagttggtagtatttctctagctattattcatgaatttgcaatgataagtcacttgcccaagtctaattgattagttccaatgagtttctggaaacttttttgcagctaaccttggttatcttagcattagcattaattggtggctgattgggaaatagacactagaaaataaaagaccttttttgtccctccttattagcgttgaagaataggctatgggnacgtgtgaagaactatgggctgacactatatgggtcccttaggaatgcagaagctccctttcatctctgtagatattttgtttcttaagctcttcaatctttttcccagtcaaaagtcagatattttgctttaggaaaatatcttttaaataattacttgacttaataccaattcaattattcataatattggtcaaccaaattgcatgtaatacattgctatattcttgaattatttaaaaaagacaagagtggtcatcatttataaaaggttcgtggtttttcatgttaatttcaactttggttttcttaagtttattattttttttgcagtaagagtcattgaaattttaagtgagtcatattccttaccatttcctgctgaaaagggtagtgtgtgagaaaaatgttagaaaagcaattaattatgttccagagcagattttcagttgcagtgtacatttctttttaatgtgagacccaaatttacatgaaaactcaaagtaagagctgggtaacagaaatggctaacttagaaggtaatgtacgtcttgcttaaaagcacatcaaagtaatctactttctcaaagagaaaatttacaggagtgaacttacatttcttttgagaacagcatggttcatagcaccaaacttcatttttacaggttgtgaatcctagagtagtttgctatcaacttctgatctttgcacattctggatttggcatataatgttacagcagtgccattgtaatgttgcacaaagtagtctagcaatttcttggttcaccaggcttagagataacattgtagaaatgatccagcatctttaacactctgtggtttaaggtggggcacttaggggtagaatcaataacaatgttagaaatcaaattagacaagataactgaaacagcatgatccatgtgtgactccaagttataaaggaggacatggattaatggtatacttctaggctataggggtagtacaagtggaaggacaccatcttagcatcagatcactttctgagcaactttggcaaatcttttaaattctctaatgtgtagttttttaatatatgacacaggtgtaaagaaaataaagcaagtgaatgtatgtgaaagccaatgctgactgggcacgggggctcacgcctgaaattctagcactttgggaggcagagccggggatatcacttgagcccaggagttgaagatcagcctgggcaacatagagaaaccctgtctctacaaacaaaacaaaacaaaaaaacaaacacaaaaaaccactcccaaattagccgggcttgctggcacactcctgttgtcccagttacccgggaggctaagatgggaggatcacctgagcttgggaagttgagactgtaatgagccgtgatagtggcactacactccagcctgatccacagagtgagaccatgtctca

SEQ ID NO: 731415 - DNA, 1366 bp, Homo sapiens
gcagttactgagaactcataagacgaagctaaaatccctcttcggatccacagtcaaccgccctgaacacatcctgcaaaaagcccagagaaagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcgcaaaaaaaaaaaaaaaaaaaaaaaaaaaaaaaaacaaaaacaacaaacaaacaaaaaaaaaaaaacaaaaacaaaaaaaacaaaaaaaaaaaaaaaaaaaaaaaaaatgggggggggggggccggcgcggccagaaagaaattaaacaccgggggggggggggggcccaagaagcaaaccagtgtcacaccatcgtttccccagaaaaacatcggggtgaaagcaaggcgggggggggtcttccccaccaaaaaaaaagcgcgcgcgggggaacacccccagagggtctttcaaacacaccacacgaggaggcccgggcgcacacgggcggggtcccaaaaccagggagcgacccccagagcgggcgccggctaataaaaaatagccacccgcaccgcaggggacaccatcagactcacctgccacagcatcattactatgcaccatcactacacaatcacagtccgggtgcacagcaagagccaccgacaagtacatcatcaacagcagcagacctaagcacaaagcgctacccacacaccacccacacgaacaacaaccaccagcaacccaaccacccaacccagcacgcacaagcaccgacaagccaggaacgcaccaccctagacacgcaaaaaccacaccctagcagacccacaccacgccccaaccccaaccaaccaccacacccccaacttcaccatcaccccacccacgtgccccacggacgaaaagcacaccccagaacctacgaaa

SEQ ID NO: 731416 - DNA, 811 bp, Homo sapiens
gcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggagacagggtttcaccatgttgcccaggctgctctcaaactcctgagctcaagcaatccacccactaaggcctcccaaagtgctaggattacagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatctcattcaatcactg

SEQ ID NO: 731417 - DNA, 1522 bp, Homo sapiens
gcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggagacagggtttcaccatgttgcccaggctgctctcaaactcctgagctcaagcaatccacccactaaggcctcccaaagtgctaggattacagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcaaacaaaaacaacaaacaaacaaaaaaaaaaaaacaaaaacaaaaaaaacaaaaaaaaaaaaaaaaaaaaaaaaaatgggggggggggggccggcgcggccagaaagaaattaaacaccgggggggggggggggcccaagaagcaaaccagtgtcacaccatcgtttccccagaaaaacatcggggtgaaagcaaggcgggggggggtcttccccaccaaaaaaaaagcgcgcgcgggggaacacccccagagggtctttcaaacacaccacacgaggaggcccgggcgcacacgggcggggtcccaaaaccagggagcgacccccagagcgggcgccggctaataaaaaatagccacccgcaccgcaggggacaccatcagactcacctgccacagcatcattactatgcaccatcactacacaatcacagtccgggtgcacagcaagagccaccgacaagtacatcatcaacagcagcagacctaagcacaaagcgctacccacacaccacccacacgaacaacaaccaccagcaacccaaccacccaacccagcacgcacaagcaccgacaagccaggaacgcaccaccctagacacgcaaaaaccacaccctagcagacccacaccacgccccaaccccaaccaaccaccacacccccaacttcaccatcaccccacccacgtgccccacggacgaaaagcacaccccagaacctacgaaa

SEQ ID NO: 731418 - DNA, 817 bp, Homo sapiens
gcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggagacagggtttcaccatgttgcccaggctgctctcaaactcctgagctcaagcaatccacccactaaggcctcccaaagtgctaggattacagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatccaaaaaaaaaaaacaaaaaa

SEQ ID NO: 731419 - DNA, 1554 bp, Homo sapiens
gcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggagacagggtttcaccatgttgcccaggctgctctcaaactcctgagctcaagcaatccacccactaaggcctcccaaagtgctaggattacagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcgcaaaaaaaaaaaaaaaaaaaaaaaaaaaaaaaaacaaaaacaacaaacaaacaaaaaaaaaaaaacaaaaacaaaaaaaacaaaaaaaaaaaaaaaaaaaaaaaaaatgggggggggggggccggcgcggccagaaagaaattaaacaccgggggggggggggggcccaagaagcaaaccagtgtcacaccatcgtttccccagaaaaacatcggggtgaaagcaaggcgggggggggtcttccccaccaaaaaaaaagcgcgcgcgggggaacacccccagagggtctttcaaacacaccacacgaggaggcccgggcgcacacgggcggggtcccaaaaccagggagcgacccccagagcgggcgccggctaataaaaaatagccacccgcaccgcaggggacaccatcagactcacctgccacagcatcattactatgcaccatcactacacaatcacagtccgggtgcacagcaagagccaccgacaagtacatcatcaacagcagcagacctaagcacaaagcgctacccacacaccacccacacgaacaacaaccaccagcaacccaaccacccaacccagcacgcacaagcaccgacaagccaggaacgcaccaccctagacacgcaaaaaccacaccctagcagacccacaccacgccccaaccccaaccaaccaccacacccccaacttcaccatcaccccacccacgtgccccacggacgaaaagcacaccccagaacctacgaaa

SEQ ID NO: 731420 - DNA, 797 bp, Homo sapiens
gcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggagacagggtttcaccatgttgcccaggctgctctcaaactcctgagctcaagcaatccacccactaaggcctcccaaagtgctaggattacagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatc

SEQ ID NO: 731421 - DNA, 1770 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcgcaaaaaaaaaaaaaaaaaaaaaaaaaaaaaaaaacaaaaacaacaaacaaacaaaaaaaaaaaaacaaaaacaaaaaaaacaaaaaaaaaaaaaaaaaaaaaaaaaatgggggggggggggccggcgcggccagaaagaaattaaacaccgggggggggggggggcccaagaagcaaaccagtgtcacaccatcgtttccccagaaaaacatcggggtgaaagcaaggcgggggggggtcttccccaccaaaaaaaaagcgcgcgcgggggaacacccccagagggtctttcaaacacaccacacgaggaggcccgggcgcacacgggcggggtcccaaaaccagggagcgacccccagagcgggcgccggctaataaaaaatagccacccgcaccgcaggggacaccatcagactcacctgccacagcatcattactatgcaccatcactacacaatcacagtccgggtgcacagcaagagccaccgacaagtacatcatcaacagcagcagacctaagcacaaagcgctacccacacaccacccacacgaacaacaaccaccagcaacccaaccacccaacccagcacgcacaagcaccgacaagccaggaacgcaccaccctagacacgcaaaaaccacaccctagcagacccacaccacgccccaaccccaaccaaccaccacacccccaacttcaccatcaccccacccacgtgccccacggacgaaaagcacaccccagaacctacgaaa

SEQ ID NO: 731422 - DNA, 845 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagcaaaaaaaaaaaacaaaaaa

SEQ ID NO: 731423 - DNA, 552 bp, Homo sapiens
gcagttactgagaactcataagacgaagctaaaatccctcttcggatccacagtcaaccgccctgaacacatcctgcaaaaagcccagagaaagattgcccagaatgcacgctacaggaaaacccattatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatc

SEQ ID NO: 731424 - DNA, 1017 bp, Homo sapiens
gcagttactgagaactcataagacgaagctaaaatccctcttcggatccacagtcaaccgccctgaacacatcctgcaaaaagcccagagaaagtgttatataaatggaatcatatagtattcagcctgcattcagcacaattctcttgagatccattcaagctgctgtgtgtatcaatagtgtgttcatttttttgttgctggacagtattccatggtatggctataccatcatttgtatgaccattcaccttctgatggacatttgaaatgtttccaatttttggctactctaaacaaagtttctatgaatatttatatataagttttgtgtgaacatagtcttcatttctctgagataaatgcccaaaagtgcaactgttggggcatatggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatctcattcaatcactg

SEQ ID NO: 731425 - DNA, 1728 bp, Homo sapiens
gcagttactgagaactcataagacgaagctaaaatccctcttcggatccacagtcaaccgccctgaacacatcctgcaaaaagcccagagaaagtgttatataaatggaatcatatagtattcagcctgcattcagcacaattctcttgagatccattcaagctgctgtgtgtatcaatagtgtgttcatttttttgttgctggacagtattccatggtatggctataccatcatttgtatgaccattcaccttctgatggacatttgaaatgtttccaatttttggctactctaaacaaagtttctatgaatatttatatataagttttgtgtgaacatagtcttcatttctctgagataaatgcccaaaagtgcaactgttggggcatatggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcaaacaaaaacaacaaacaaacaaaaaaaaaaaaacaaaaacaaaaaaaacaaaaaaaaaaaaaaaaaaaaaaaaaatgggggggggggggccggcgcggccagaaagaaattaaacaccgggggggggggggggcccaagaagcaaaccagtgtcacaccatcgtttccccagaaaaacatcggggtgaaagcaaggcgggggggggtcttccccaccaaaaaaaaagcgcgcgcgggggaacacccccagagggtctttcaaacacaccacacgaggaggcccgggcgcacacgggcggggtcccaaaaccagggagcgacccccagagcgggcgccggctaataaaaaatagccacccgcaccgcaggggacaccatcagactcacctgccacagcatcattactatgcaccatcactacacaatcacagtccgggtgcacagcaagagccaccgacaagtacatcatcaacagcagcagacctaagcacaaagcgctacccacacaccacccacacgaacaacaaccaccagcaacccaaccacccaacccagcacgcacaagcaccgacaagccaggaacgcaccaccctagacacgcaaaaaccacaccctagcagacccacaccacgccccaaccccaaccaaccaccacacccccaacttcaccatcaccccacccacgtgccccacggacgaaaagcacaccccagaacctacgaaa

SEQ ID NO: 731426 - DNA, 1023 bp, Homo sapiens
gcagttactgagaactcataagacgaagctaaaatccctcttcggatccacagtcaaccgccctgaacacatcctgcaaaaagcccagagaaagtgttatataaatggaatcatatagtattcagcctgcattcagcacaattctcttgagatccattcaagctgctgtgtgtatcaatagtgtgttcatttttttgttgctggacagtattccatggtatggctataccatcatttgtatgaccattcaccttctgatggacatttgaaatgtttccaatttttggctactctaaacaaagtttctatgaatatttatatataagttttgtgtgaacatagtcttcatttctctgagataaatgcccaaaagtgcaactgttggggcatatggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatccaaaaaaaaaaaacaaaaaa

SEQ ID NO: 731427 - DNA, 1760 bp, Homo sapiens
gcagttactgagaactcataagacgaagctaaaatccctcttcggatccacagtcaaccgccctgaacacatcctgcaaaaagcccagagaaagtgttatataaatggaatcatatagtattcagcctgcattcagcacaattctcttgagatccattcaagctgctgtgtgtatcaatagtgtgttcatttttttgttgctggacagtattccatggtatggctataccatcatttgtatgaccattcaccttctgatggacatttgaaatgtttccaatttttggctactctaaacaaagtttctatgaatatttatatataagttttgtgtgaacatagtcttcatttctctgagataaatgcccaaaagtgcaactgttggggcatatggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcgcaaaaaaaaaaaaaaaaaaaaaaaaaaaaaaaaacaaaaacaacaaacaaacaaaaaaaaaaaaacaaaaacaaaaaaaacaaaaaaaaaaaaaaaaaaaaaaaaaatgggggggggggggccggcgcggccagaaagaaattaaacaccgggggggggggggggcccaagaagcaaaccagtgtcacaccatcgtttccccagaaaaacatcggggtgaaagcaaggcgggggggggtcttccccaccaaaaaaaaagcgcgcgcgggggaacacccccagagggtctttcaaacacaccacacgaggaggcccgggcgcacacgggcggggtcccaaaaccagggagcgacccccagagcgggcgccggctaataaaaaatagccacccgcaccgcaggggacaccatcagactcacctgccacagcatcattactatgcaccatcactacacaatcacagtccgggtgcacagcaagagccaccgacaagtacatcatcaacagcagcagacctaagcacaaagcgctacccacacaccacccacacgaacaacaaccaccagcaacccaaccacccaacccagcacgcacaagcaccgacaagccaggaacgcaccaccctagacacgcaaaaaccacaccctagcagacccacaccacgccccaaccccaaccaaccaccacacccccaacttcaccatcaccccacccacgtgccccacggacgaaaagcacaccccagaacctacgaaa

SEQ ID NO: 731428 - DNA, 1003 bp, Homo sapiens
gcagttactgagaactcataagacgaagctaaaatccctcttcggatccacagtcaaccgccctgaacacatcctgcaaaaagcccagagaaagtgttatataaatggaatcatatagtattcagcctgcattcagcacaattctcttgagatccattcaagctgctgtgtgtatcaatagtgtgttcatttttttgttgctggacagtattccatggtatggctataccatcatttgtatgaccattcaccttctgatggacatttgaaatgtttccaatttttggctactctaaacaaagtttctatgaatatttatatataagttttgtgtgaacatagtcttcatttctctgagataaatgcccaaaagtgcaactgttggggcatatggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatc

SEQ ID NO: 731429 - DNA, 1016 bp, Homo sapiens
gcagttactgagaactcataagacgaagctaaaatccctcttcggatccacagtcaaccgccctgaacacatcctgcaaaaagcccagagaaagtgttatataaatggaatcatatagtattcagcctgcattcagcacaattctcttgagatccattcaagctgctgtgtgtatcaatagtgtgttcatttttttgttgctggacagtattccatggtatggctataccatcatttgtatgaccattcaccttctgatggacatttgaaatgtttccaatttttggctactctaaacaaagtttctatgaatatttatatataagttttgtgtgaacatagtcttcatttctctgagataaatgcccaaaagtgcaactgttggggcatatggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtaagaacctcaagatccccagaagctttctaacagcccaatcagagaaatgttcatagagcccacccatggaatttaatgccaaaggtgtctaatgacccagcctctgtcgagcatttgtacaggtggggaatacatttctacccattaattaaaagagtcaattgtcttgtgggtatagactggatttattcagaatgaggagaataggggtagaggtgacaaggggcaggttgggagaaagtacagcttacttgtgctaaaaatatttcctaaaaaggagactgtgcaaatgtagtatgcatctacttatttcagcagaatgcaaacaattttatgtaat

SEQ ID NO: 731430 - DNA, 1600 bp, Homo sapiens; identical to SEQ ID NO: 451814

SEQ ID NO: 731431 - DNA, 1620 bp, Homo sapiens; identical to SEQ ID NO: 451805

SEQ ID NO: 731432 - DNA, 1566 bp, Homo sapiens; identical to SEQ ID NO: 451806

SEQ ID NO: 731433 - DNA, 1499 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731434 - DNA, 1553 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731435 - DNA, 1512 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731436 - DNA, 1445 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731437 - DNA, 1566 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731438 - DNA, 1499 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731439 - DNA, 1064 bp, Homo sapiens
gtgagaaagccctagcacttgagacctgtcagaattcatccactttccctgagcttgtggatctcacgtgtcctagctctcactttaactccgtgttgcgacaccttggcccttaatctagccccatttccattctggattttcccattgccctcatatggggaaacccacaccccactaaccccagccatctcttccaccttggacctcactctgacctctggcctccttctgtgttctcctcacccatttctctctccaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731440 - DNA, 997 bp, Homo sapiens
gtgagaaagccctagcacttgagacctgtcagaattcatccactttccctgagcttgtggatctcacgtgtcctagctctcactttaactccgtgttgcgacaccttggcccttaatctagccccatttccattctggattttcccattgccctcatatggggaaacccacaccccactaaccccagccatctcttccaccttggacctcactctgacctctggcctccttctgtgttctcctcacccatttctctctccaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731441 - DNA, 1017 bp, Homo sapiens
aaatccttagggagtgcccgccaaccccatgatgttggccttacctggaaacttagccactgttttccacacttgcctttctttcaggcacctgctgattccagtttcagccagggcacagtgcccaacattgctgaccaagtcttgctctatttctccttctcacctggcctcttccatcttggcctctggatgcattctctccctctcatgactcatttctgcattcatcactagcctcttctctgcctgggcttctgccagcggccctagagcaacctatggtattccacggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731442 - DNA, 950 bp, Homo sapiens
aaatccttagggagtgcccgccaaccccatgatgttggccttacctggaaacttagccactgttttccacacttgcctttctttcaggcacctgctgattccagtttcagccagggcacagtgcccaacattgctgaccaagtcttgctctatttctccttctcacctggcctcttccatcttggcctctggatgcattctctccctctcatgactcatttctgcattcatcactagcctcttctctgcctgggcttctgccagcggccctagagcaacctatggtattccacggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731443 - DNA, 867 bp, Homo sapiens
aatgaatgatatcagtcagagtagggaagggaaaagaggcttcaagaatgactcagctttcgtggactcagcaactgagtggctggtggttttgttttctaaaattgggaaagactagggagtgtgtgtgttggtggggggcagaaatcagtttgggcatattaggttttgggtgcctattggcaccccataagcatgtcaggtaggcagctgatttggagcctaaacctcaaaggagaggtcagtcagagctgacgagaacagattggaagtcatcagcatatagatggcatttaaagcccctggactaggtgagattaccaaggaagtgaaggtagagagagaagagaagaggcccaaagtaggggattccaatatttagatatcaggttgaagaaaagagtagtcaaaaaagataagaggaatactgggagagtcaggtgtcacagaagccaagttccaaaaaaagacatttaaaggagaaggaagtagtgagcagtccagtgctcctgagaggtagggtcagatgagaacagagaattgaccatgagatttcgcaaattggagaatactagcaacctggataagaacaatttcaatggttgagggaaacagaagtgtaattgaagaggattgaggaaaaaagacaaatgggagcctagataattccttaataagttgttgtgaaaagaggagaagaaaaacggggtgctagcccagctactccctcactcttccaccacctcatagggagagactggagaacacagccagagtgagaacattcagtagaagtggtgcttcctttttaagttctggacactgtatttcattatctataaccgcatctctgtacatggacacctg

SEQ ID NO: 731444 - DNA, 1379 bp, Homo sapiens; identical to SEQ ID NO: 451819

SEQ ID NO: 731445 - DNA, 1312 bp, Homo sapiens
agggcgtaacccggtctcaccaaatgcctgttgattgattggacaaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggtgagaaagccctagcacttgagacctgtcagaattcatccactttccctgagcttgtggatctcacgtgtcctagctctcactttaactccgtgttgcgacaccttggcccttaatctagccccatttccattctggattttcccattgccctcatatggggaaacccacaccccactaaccccagccatctcttccaccttggacctcactctgacctctggcctccttctgtgttctcctcacccatttctctctccaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731446 - DNA, 1284 bp, Homo sapiens
agggcgtaacccggtctcaccaaatgcctgttgattgattggacaaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggtgagaaagccctagcacttgagacctgtcagaattcatccactttccctgagcttgtggatctcacgtgtcctagctctcactttaactccgtgttgcgacaccttggcccttaatctagccccatttccattctggattttcccattgccctcatatggggaaacccacaccccactaaccccagccatctcttccaccttggacctcactctgacctctggcctccttctgtgttctcctcacccatttctctctccaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731447 - DNA, 1455 bp, Homo sapiens
gtgacatgttgttccagaggttccggaatgtgtgttttcctgttggaaggaaacttcgcagagtagaaaagggatctgagacttttggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731448 - DNA, 1388 bp, Homo sapiens
gtgacatgttgttccagaggttccggaatgtgtgttttcctgttggaaggaaacttcgcagagtagaaaagggatctgagacttttggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731449 - DNA, 1360 bp, Homo sapiens
gtgacatgttgttccagaggttccggaatgtgtgttttcctgttggaaggaaacttcgcagagtagaaaagggatctgagacttttggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731450 - DNA, 1509 bp, Homo sapiens; identical to SEQ ID NO: 451817

SEQ ID NO: 731451 - DNA, 1442 bp, Homo sapiens
gtgacatgttgttccagaggttccggaatgtgtgttttcctgttggaaggaaacttcgcagagtagaaaagggatctgagacttttggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731452 - DNA, 1414 bp, Homo sapiens
gtgacatgttgttccagaggttccggaatgtgtgttttcctgttggaaggaaacttcgcagagtagaaaagggatctgagacttttggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731453 - DNA, 1499 bp, Homo sapiens
catggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731454 - DNA, 1432 bp, Homo sapiens
catggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731455 - DNA, 1404 bp, Homo sapiens
catggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731456 - DNA, 1553 bp, Homo sapiens
catggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731457 - DNA, 1486 bp, Homo sapiens
catggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731458 - DNA, 1458 bp, Homo sapiens
catggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731459 - DNA, 1553 bp, Homo sapiens
catggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731460 - DNA, 1486 bp, Homo sapiens
catggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731461 - DNA, 1458 bp, Homo sapiens
catggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731462 - DNA, 1607 bp, Homo sapiens
catggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731463 - DNA, 1540 bp, Homo sapiens
catggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731464 - DNA, 1512 bp, Homo sapiens
catggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731465 - DNA, 969 bp, Homo sapiens
gtgagaaagccctagcacttgagacctgtcagaattcatccactttccctgagcttgtggatctcacgtgtcctagctctcactttaactccgtgttgcgacaccttggcccttaatctagccccatttccattctggattttcccattgccctcatatggggaaacccacaccccactaaccccagccatctcttccaccttggacctcactctgacctctggcctccttctgtgttctcctcacccatttctctctccaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731466 - DNA, 922 bp, Homo sapiens
aaatccttagggagtgcccgccaaccccatgatgttggccttacctggaaacttagccactgttttccacacttgcctttctttcaggcacctgctgattccagtttcagccagggcacagtgcccaacattgctgaccaagtcttgctctatttctccttctcacctggcctcttccatcttggcctctggatgcattctctccctctcatgactcatttctgcattcatcactagcctcttctctgcctgggcttctgccagcggccctagagcaacctatggtattccacggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731467 - DNA, 1417 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731468 - DNA, 1471 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731469 - DNA, 1471 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagactataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731470 - DNA, 1525 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggatgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731471 - DNA, 332 bp, Homo sapiens
gtcagtccaggctggaatccaagaacctggagtagtggtgggttggtagtgatgccagtagtgatggtgatagtggtagtgatggtggtggtggagccactatgtggctttttaaggaagggaaatagagaagccacgtatggtctagaggtcacgtgagggaaggagaggaagtcattctggtgaaggcaactgtgtgtaattctgtgtgaatagtccctcattgttccccatgacccttaggacaaatctaccctctttagtcttacatacaagtctctccatggccaaatccctattggcccttcagctttgacttttattatactttt

SEQ ID NO: 731472 - DNA, 1332 bp, Homo sapiens; identical to SEQ ID NO: 451809

SEQ ID NO: 731473 - DNA, 537 bp, Homo sapiens
catggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatgccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 731474 - DNA, 1771 bp, Homo sapiens; identical to SEQ ID NO: 63152
  misc_feature (939)..(939): n is a, c, g, or t
  misc_feature (1164)..(1165): n is a, c, g, or t
  misc_feature (1168)..(1168): n is a, c, g, or t

SEQ ID NO: 731475 - DNA, 925 bp, Homo sapiens; identical to SEQ ID NO: 63153

SEQ ID NO: 731476 - DNA, 2138 bp, Homo sapiens; identical to SEQ ID NO: 64347

SEQ ID NO: 731477 - DNA, 1028 bp, Homo sapiens; identical to SEQ ID NO: 454330

SEQ ID NO: 731478 - DNA, 614 bp, Homo sapiens; identical to SEQ ID NO: 454332
  misc_feature (537)..(537): n is a, c, g, or t
  misc_feature (610)..(610): n is a, c, g, or t

SEQ ID NO: 731479 - DNA, 676 bp, Homo sapiens
  misc_feature (5)..(5): n is a, c, g, or t
  misc_feature (11)..(11): n is a, c, g, or t
gtctnccattnatccatactctcagaaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaa

SEQ ID NO: 731480 - DNA, 586 bp, Homo sapiens; identical to SEQ ID NO: 454355

SEQ ID NO: 731481 - DNA, 773 bp, Homo sapiens; identical to SEQ ID NO: 454333

SEQ ID NO: 731482 - DNA, 790 bp, Homo sapiens; identical to SEQ ID NO: 454370
  misc_feature (713)..(713): n is a, c, g, or t
  misc_feature (786)..(786): n is a, c, g, or t

SEQ ID NO: 731483 - DNA, 852 bp, Homo sapiens; identical to SEQ ID NO: 454343

SEQ ID NO: 731484 - DNA, 1356 bp, Homo sapiens; identical to SEQ ID NO: 454334

SEQ ID NO: 731485 - DNA, 1118 bp, Homo sapiens
  misc_feature (1041)..(1041): n is a, c, g, or t
  misc_feature (1114)..(1114): n is a, c, g, or t
atccttattctatatctcttggtatttagtgtaaaaattttaaaatctttacctagcaatcttgaggaagaaacttgataactgataatacatgagattgttacctaagtgaaatataatcctatatattcaacaaactttagagaaataagataaattttaaagtaaatgacttctgtagttttatagatcctccaaaccaatctagtctcagatctcaccttcatcatttctctcatttccttttggcctaattaatcaaaatccttcctagaatgttcatttctggccagtatgtcttcctgaatatgaataagaaataaaataccatttgatgtttgaaattatgggggtaatctcaatgacggaaatagatgaccaggaaaagggaaacgaatgcctgattcattatattcatgaagatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggtcatctgaaccgtgagactacctgctggncggacttcatcctgagatggtgatggctcgctttggtatatactgtcaatgtaccaggatactaatgcatttntctg

SEQ ID NO: 731486 - DNA, 1229 bp, Homo sapiens
atccttattctatatctcttggtatttagtgtaaaaattttaaaatctttacctagcaatcttgaggaagaaacttgataactgataatacatgagattgttacctaagtgaaatataatcctatatattcaacaaactttagagaaataagataaattttaaagtaaatgacttctgtagttttatagatcctccaaaccaatctagtctcagatctcaccttcatcatttctctcatttccttttggcctaattaatcaaaatccttcctagaatgttcatttctggccagtatgtcttcctgaatatgaataagaaataaaataccatttgatgtttgaaattatgggggtaatctcaatgacggaaatagatgaccaggaaaagggaaacgaatgcctgattcattatattcatgaagatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctgaatgcgaatctccaaaaaaatggtagccaatcattcacattcgaaagtctatatcgtcctga

SEQ ID NO: 731487 - DNA, 1275 bp, Homo sapiens
atccttattctatatctcttggtatttagtgtaaaaattttaaaatctttacctagcaatcttgaggaagaaacttgataactgataatacatgagattgttacctaagtgaaatataatcctatatattcaacaaactttagagaaataagataaattttaaagtaaatgacttctgtagttttatagatcctccaaaccaatctagtctcagatctcaccttcatcatttctctcatttccttttggcctaattaatcaaaatccttcctagaatgttcatttctggccagtatgtcttcctgaatatgaataagaaataaaataccatttgatgtttgaaattatgggggtaatctcaatgacggaaatagatgaccaggaaaagggaaacgaatgcctgattcattatattcatgaagatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctgcccctggctaaccagggtccctttaacgcgcattttctaggccctgaatgcgaatctccaaaaaaatggtagccaatcattcacattcgaaagtctatatcgtcctga

SEQ ID NO: 731488 - DNA, 1254 bp, Homo sapiens
atccttattctatatctcttggtatttagtgtaaaaattttaaaatctttacctagcaatcttgaggaagaaacttgataactgataatacatgagattgttacctaagtgaaatataatcctatatattcaacaaactttagagaaataagataaattttaaagtaaatgacttctgtagttttatagatcctccaaaccaatctagtctcagatctcaccttcatcatttctctcatttccttttggcctaattaatcaaaatccttcctagaatgttcatttctggccagtatgtcttcctgaatatgaataagaaataaaataccatttgatgtttgaaattatgggggtaatctcaatgacggaaatagatgaccaggaaaagggaaacgaatgcctgattcattatattcatgaagatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctctttaatcggcatttttcaagatctgaatgcgaatctccaaaaaaatggtagccaatcattcacattcgaaagtctatatcgtcctga

SEQ ID NO: 731489 - DNA, 901 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctgaatgcgaatctccaaaaaaatggtagccaatcattcacattcgaaagtctatatcgtcctga

SEQ ID NO: 731490 - DNA, 947 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctgcccctggctaaccagggtccctttaacgcgcattttctaggccctgaatgcgaatctccaaaaaaatggtagccaatcattcacattcgaaagtctatatcgtcctga

SEQ ID NO: 731491 - DNA, 926 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctctttaatcggcatttttcaagatctgaatgcgaatctccaaaaaaatggtagccaatcattcacattcgaaagtctatatcgtcctga

SEQ ID NO: 731492 - DNA, 1001 bp, Homo sapiens; identical to SEQ ID NO: 454369

SEQ ID NO: 731493 - DNA, 772 bp, Homo sapiens
tgtcaaacctgctcctgtgccagagcgtggcccccttgcccatctgtcccggcggggctgcccgatgccaggtgacccttccgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaa

SEQ ID NO: 731494 - DNA, 3290 bp, Homo sapiens
  misc_feature (1540)..(1540): n is a, c, g, or t
  misc_feature (3281)..(3286): n is a, c, g, or t
  misc_feature (3288)..(3290): n is a, c, g, or t
gtcaatttcgggaggataaagcaaaaagaaaaaaatgctaatgtgagaacaagcatgccagcaagccatggtcaccccacacccaataaaacaggtaaacaggaaaacacaaaaagtacctgtgagtatgaatagtatatataaaatattttcaaagaaacaagttactcttatgtatcttcaatagaaaggaaaaactattatttattcagcttatgtataattatgttttctgttgctgattcagttacttttgggaaaggcagtacaagtaaagccactcaatatggctttgtgttggacattcgtagtttcttagaacagctaacgaaaatgtagcttttatgccctttgttttttaacataaagaatctgagattgaagaggtagtgtgttcaggattacagaatgataaatggtggaatctagactcaaatgtaaagcagtattatttccaaagccagctacttttgtgttcagctatattgtttttgaattttcagtgatttattggtaggctttttgttatctgggaattccttctattaaaattatattgtcaagtgttgaaatatgcaggttttaactagttgcattgacacagcttgattttgtgtcactctaaaactcaccccctgctcccccagggagcaaaaacaaataaaaaccacatataaacatagctttctaggaacagtagtttcagatactgcttcctaaattgttcaaatatcttagcttttcagttctgtttgttccaaggtggtcatatattgttatttttcaataatcagatttagttgttttgccatttttgtttagggagttactattaattgttttttaatattaagcatgataaacttcagatgtttctctttttaaagacctggttttcgtatattgagtggtttcacttttgttaccttgccccaaagtaattgaatcagcaacagaagaaagcatgacattttaattgtctacgtcaaattacataatctagtgaagtatgaagactcactgttaaattattaatgacttttgtttattaaaccaagcagtgaaagagatggtatagggacattcccctcatattttataagtcatactactggctaaatagtatcaggattgtttttagctctgcattgctaactgagtgatctgtctaaaacttaaattagactgtgtccctcctttgcttttaagtcttaaaaactgctgcttaccagtcaaagtctatattacttagtatggtatttaaagcttttaagttctagccccctgctgactaccctaacgtcattcctatatatttcaaagcctatcctaccgaagtttgtctgctggcaacactaactactatttttctgtatgtagagagattctacactttggtttatatattctattctgtcctatttgactgttttcccttaccaccagactatttggtctcctttttccccacatttgtaactttttatattctttttaagacgtgctcttgctcttttgctcagagttgagtgcagtcgtnaatcatagctcatcgtggccttgaactcctgggctcaagcaatcttcctgcctcagcctcccaagtgtagctggggctacagacgtacaccagcatgcctggctaattttatttttatttttatttttagagacagggtgttgttgtgttgcccaggctggtcttaaactcctggcctcaactcctgcctcagctgggattacaggtgtgagccactgggctgggtggctatcatgttttatctaaaattagaaactccttgaggcagggaccatttatctttgtatctttagtgttcagcacctagtagtaactcagcaaatgtttgttttctttctgacatatttgtcatatttgtatttgttgtatttagcatcagaaagccaaatatggtcattcaacgttaatttgactgattccttttgttattttagtccagaattgctaccaaagtgtttaggtttgacctttttgtgcccaggaagtctagtcgttttgatgataaatctaaattggttgaggtgtaatgaaaaagacaaccaggtgtctagaagtgactgtgacaattgcagatttatcttgtttgtgcatgctggtttttttttttttcagtgttcaaagcctgtattgcatcaggttttcaggtttagatttcctaaatttggaacacaaagttccctttttagaagaataggtattgagcccttgagcgtgggtagaaagatagagacagagtgatttgcaaaataatggaggatcatatttatatatgaattttcacttatttgaactttcagatatcagctcaaaagctttggtataagtaaagtatattaatgagactccttggatgaaagtaaccaaaaccagtaaaaataaggtaataaggatgtaatagtttcttatggacactcaacagctagaatgcagttagtctcagaaaagaattagaacaaataactggaaggccatcaggagtccaaaaccatcactcttttatattttatattttatttttctctcttcagatgagcattctctttctatgtccatatggtagaaggcggcagctccatagattatggcttcagatgttacagttccgctaaatgcagggacagacttgctatctttcagtcccacttacatatcctggggagagagcaaatgattgactggcttgagtcaggtgcccgttccctttccaatctgctccatctaggagggcagtgttacctggtaccaaaatagatgttagagggccacccctttcaaaagggagaatagctctcacaacagggcttctatgttgtgcaggttgcttattccacatgctgcttgccaagctgtatgcctataagggctgcagttttaaaatttgtacaaaggtgctttatggatttgtggtaaccttttctcagagaaaggaggagtcattgtgaattggggggctattccaagggggtctgctatgtcatttttgggggatatttattgtccatcttagtattgccagactcttagcattgaaatattagattgtctctcacccttgggccatggagttttattgcagcaaaaacaaaaatccatatgtatataagtgttttctcaataggtatattgacagtggacttactatgatgtggagctttgacatttgtggacctgctgcggtgtccttacactcattgagaaccattgatgttacgcaaatgctattaaactttgcatctaagannnnnnannn

SEQ ID NO: 731495 - DNA, 1583 bp, Homo sapiens; identical to SEQ ID NO: 62735
  misc_feature (14)..(14): n is a, c, g, or t
  misc_feature (16)..(16): n is a, c, g, or t
  misc_feature (23)..(23): n is a, c, g, or t
  misc_feature (30)..(30): n is a, c, g, or t

SEQ ID NO: 731496 - DNA, 1843 bp, Homo sapiens; identical to SEQ ID NO: 62738
  misc_feature (14)..(14): n is a, c, g, or t
  misc_feature (16)..(16): n is a, c, g, or t
  misc_feature (23)..(23): n is a, c, g, or t
  misc_feature (30)..(30): n is a, c, g, or t

SEQ ID NO: 731497 - DNA, 1411 bp, Homo sapiens; identical to SEQ ID NO: 62739
  misc_feature (14)..(14): n is a, c, g, or t
  misc_feature (16)..(16): n is a, c, g, or t
  misc_feature (23)..(23): n is a, c, g, or t
  misc_feature (30)..(30): n is a, c, g, or t

SEQ ID NO: 731498 - DNA, 847 bp, Homo sapiens
  misc_feature (14)..(14): n is a, c, g, or t
  misc_feature (16)..(16): n is a, c, g, or t
  misc_feature (23)..(23): n is a, c, g, or t
  misc_feature (30)..(30): n is a, c, g, or t
ccccgccacaaccnangctagtncgaggcngggtgtgtaatcggccgagggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggcccccgagcggcgcccggcggcggaactgctacgaaggcgcctactacaacgaggcgcccagcg

SEQ ID NO: 731499 - DNA, 1151 bp, Homo sapiens
  misc_feature (14)..(14): n is a, c, g, or t
  misc_feature (16)..(16): n is a, c, g, or t
  misc_feature (23)..(23): n is a, c, g, or t
  misc_feature (30)..(30): n is a, c, g, or t
ccccgccacaaccnangctagtncgaggcngggtgtgtaatcggccgaggctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggcccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccaacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgc

SEQ ID NO: 731500 - DNA, 2494 bp, Homo sapiens; identical to SEQ ID NO: 62734
  misc_feature (14)..(14): n is a, c, g, or t
  misc_feature (16)..(16): n is a, c, g, or t
  misc_feature (23)..(23): n is a, c, g, or t
  misc_feature (30)..(30): n is a, c, g, or t

SEQ ID NO: 731501 - DNA, 521 bp, Homo sapiens
tgttggcaggcctttcatcccatctacaatgggactataagatttattaattagtaaaacagcaatagttataacaaaataaaaaccaaaaaacacttaaaaatattcagagagttgcgtagaatattctagaatttgtctatatttttgaggttggtgttctagtttcctgatagctggacagccaactcattattgtattgaattgcattaaccattcaaattctctctgcagttacagaatttgttgggcggagatatcggagaacagtggggattttttaccaagttgcctatacagttgggctcctggtgctagctggggtggcttacgcacttcctcactggaggtggttgcagttcacagttgctctgcccaacttcttcttcttgctctattactggtaagtccatttggaataaaaaggaaataaatcaaagtattttattctgctaagaagtctgccttccttaatgcacactatctttctgattctgagattgctttcactctccagacc

SEQ ID NO: 731502 - DNA, 734 bp, Homo sapiens
accaaaggagctcaactgacttattttacctccccattctggagctttagagaattccaaaaccatagggtgatttgggaacaggtccaaagggcatggcctgggaccaacaaaatgaaaaaagcagcatttctacgatgaatatcaagcaatgtcctggcattcccgaagaccaagatgattgagaaaacttgcaatttgaacaaaatgttttaattgcagtcttcatttatcaagctgttgaaaaaccaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattctcagcattcctaggacattggacattggttttctggagggttttttttccatctttgtatttttttaaatttgattcttttctttgcaatgctatctaaccagaatacataggggaactgtgggctaggcaaacaaaatagaaaaaagtgtgaaaaacagtaaagttgggagaggagcatctattttcttaaagaaataaaacaccc

SEQ ID NO: 731503 - DNA, 2264 bp, Homo sapiens
gtgcacctttgaagtcagctggaccaaggaaaggccctgccctgaaggctggtcacttgcagaggtaaactcccctctttgacttctggccagggtttgtgctgagctggctgcagccgctctcagcctcgctccgggcacgtcgggcagcctcgggccctcctgcctgcaggatcatgcccaccaccgtggacgatgtcctggagcatggaggggagtttcactttttccagaagcaaatgtttttcctcttggctctgctctcggctaccttcgcgcccatctacgtgggcatcgtcttcctgggcttcacccctgaccaccgctgccggagccccggagtggccgagctgagtctgcgctgcggctggagtcctgcagaggaactgaactacacggtgccgggcccaggacctgcgggcgaagcctccccaagacagtgtaggcgctacgaggtggactggaaccagagcaccttcgactgcgtggaccccctggccagcctggacaccaacaggagccgcctgccactgggcccctgccgggacggctgggtgtacgagacgcctggctcgtccatcgtcaccgagtttaacctggtatgtgccaactcctggatgttggacctattccagtcatcagtgaatgtaggattctttattggctctatgagtatcggctacatagcagacaggtttggccgtaagctctgcctcctaactacagtcctcataaatgctgcagctggagttctcatggccatttccccaacctatacgtggatgttaatttttcgcttaatccaaggactggtcagcaaagcaggctggttaataggctacatcctgattacagaatttgttgggcggagatatcggagaacagtggggattttttaccaagttgcctatacagttgggctcctggtgctagctggggtggcttacgcacttcctcactggaggtggttgcagttcacagttgctctgcccaacttcttcttcttgctctattactggtgcatacctgagtctcccaggtggctgatctcccagaataagaatgctgaagccatgagaatcattaagcacatcgcaaagaaaaatggaaaatctctacccgcctcccttcagcgcctgagacttgaagaggaaactggcaagaaattgaacccttcatttcttgacttggtcagaactcctcagataaggaaacatactatgatattgatgtacaactggttcacgagctctgtgctctaccagggcctcatcatgcacatgggccttgcaggtgacaatatctacctggatttcttctactctgccctggttgaattcccagctgccttcatgatcatcctcaccatcgaccgcatcggacgccgttacccttgggctgcatcaaatatggttgcaggggcagcctgtctggcctcagtttttatacctggtgatctacaatggctaaaaattattatctcatgcttgggaagaatggggatcacaatggcctatgagatagtctgcctggtcaatgctgagctgtaccccacattcattaggaatcttggcgtccacatctgttcctcaatgtgtgacattggtggcatcatcacgccattcctggtctaccggctcactaacatctggcttgagctcccgctgatggttttcggcgtacttggcttggttgctggaggtctggtgctgttgcttccagaaactaaagggaaagctttgcctgagaccatcgaggaagccgaaaatatgcaaagaccaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattctcagcattcctaggacattggacattggttttctggagggttttttttccatctttgtatttttttaaatttgattcttttctttgcaatgctatctaaccagaatacataggggaactgtgggctaggcaaacaaaatagaaaaaagtgtgaaaaacagtaaagttgggagaggagcatctattttcttaaagaaataaaacaccc

SEQ ID NO: 731504 - DNA, 824 bp, Homo sapiens; identical to SEQ ID NO: 326839

SEQ ID NO: 731505 - DNA, 908 bp, Homo sapiens
gaacaggtccaaagggcatggcctgggaccaacaaaatgaaaaaagcagcatttctacgatgaatatcaagcaatgtcctggcattcccgaagaccaagatgattgagaaaacttgcaatttgaacaaaatgttttaattgcagtcttcatttatcaagctgttgaaaaaccaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattctcagcattcctaggacattggacattggttttctggagggttttttttccatctttgtatttttttaaatttgattcttttctttgcaatgctatctaaccagaatacataggggaactgtgggctaggcaaacaaaatagaaaaaagtgtgaaaaacagtaaagttgggagaggagcatctattttcttaaagaaataaaacacccaaaacaatataaagttgtccagaatgtatgtcaagaattttagataggcctttcagtaacacaggtgacgaaatttttaaaaatacattgattattatctaggttagacttaaagtgaatctcaaataaaagaatcaggaatacaacttaagtaatcatgaggtccttccatatttagattgggtaagcatgaatgtgtattttctacaaaagaccttgagaagagttcaataaaaaatgttagcattataa

SEQ ID NO: 731506 - DNA, 2159 bp, Homo sapiens; identical to SEQ ID NO: 326838

SEQ ID NO: 731507 - DNA, 662 bp, Homo sapiens
accaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattcttttctttgcaatgctatctaaccagaatacataggggaactgtgggctaggcaaacaaaatagaaaaaagtgtgaaaaacagtaaagttgggagaggagcatctattttcttaaagaaataaaacacccaaaacaatataaagttgtccagaatgtatgtcaagaattttagataggcctttcagtaacacaggtgacgaaatttttaaaaatacattgattattatctaggttagacttaaagtgaatctcaaataaaagaatcaggaatacaacttaagtaatcatgaggtccttccatatttagattgggtaagcatgaatgtgtattttctacaaaagaccttgagaagagttcaataaaaaatgttagcattataa

SEQ ID NO: 731508 - DNA, 2966 bp, Homo sapiens
  misc_feature (2)..(2): n is a, c, g, or t
  misc_feature (7)..(7): n is a, c, g, or t
  misc_feature (9)..(9): n is a, c, g, or t
  misc_feature (41)..(41): n is a, c, g, or t
tnacaantnttaatgaggcaatgttaaatatggacccaatntcagacaaatacatagaaaggagtaagggccaactctcatgcataaggtatcccatcctatagcaaatcagatatataggtacgcttgatgccacaaattttttaaaaaattgtccattttgttgcgtgtgcacctcttgccataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggtaagatgttatttaaatcagtaaaaggctgactttggaatctttttcctttttcttttaagaaaaagtcaacgttaggattaaatatatattcaatagcaagtgcatgcaccagaaatttgctgcagtgtcagttgagggatattttttatacattcagtcactctgtaaatatacatattgttttcctttaaaatgggcactgaaatatacagaaaaaaatcactttataaaatgtgaggtttataggtactgtgttggtctggatttttcaagtgctttttacaaagatatatttatcctaaaaacatacagataaaatttcgaagactgctttaatatctaaataaaatctaccctatatacacacattgaattacattactgcagagattaaaaaaaaaagacacgacagccatttttctcatctgagtaagaaagcatatcatcaaaaatagtaatagcctacaactgcaactatttatttgcaaagaatgctattttatcatattaaggctctagaaagataaataagaaagaatatggttagaaaaggggggagggagagagaaaataaaggagaaaatgcaggagagagtagggagagagtctctctctaccacatagcccaatgaaggattaagcattgactataaatgaagggagctttgttagtttaatcactggaacaattataaaaggactcgacaacaacgaggtttattgaaaattttgcctaatgctaactgacccatgcagatgcctaaactgtatttgcatattaaaagaagggtgtatctgtttgtttctaggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaaaatacactaagaagtctcgaggttctcaacctcagtagtaacaaactttggacagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggattttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataactgtgtcatttggctttccagtcataccaactttagcagaatcaaaatgacctcaccatttttgttctagggt

SEQ ID NO: 731509 - DNA, 810 bp, Homo sapiens
cgcaggtgcatgctgaggtgatctagaggatcccacggggattttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataactgtgtcatttggctttccagtcataccaactttagcagaatcaaaatgacctcaccatttttgttctagggt

SEQ ID NO: 731510 - DNA, 1965 bp, Homo sapiens
atatataggtacgcttgatgccacaaattttttaaaaaattgtccattttgttgcgtgtgcacctcttgccataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaaaatacactaagaagtctcgaggttctcaacctcagtagtaacaaactttggacagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggattttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctc

SEQ ID NO: 731511 - DNA, 2042 bp, Homo sapiens
atatataggtacgcttgatgccacaaattttttaaaaaattgtccattttgttgcgtgtgcacctcttgccataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaaaatacactaagaagtctcgaggttctcaacctcagtagtaacaaactttggacagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggattttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataactgtgtcatttggctttccagtcataccaactttagcagaatcaaaatgacctcaccatttttgttctagggt

SEQ ID NO: 731512 - DNA, 1915 bp, Homo sapiens
atatataggtacgcttgatgccacaaattttttaaaaaattgtccattttgttgcgtgtgcacctcttgccataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaaaatacactaagaagtctcgaggttctcaacctcagtagtaacaaactttggacagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggattttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacagaatccccgtgggactcctctagactcactca

SEQ ID NO: 731513 - DNA, 683 bp, Homo sapiens
cgcaggtgcatgctgaggtgatctagaggatcccacggggattttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacagaatccccgtgggactcctctagactcactca

SEQ ID NO: 731514 - DNA, 663 bp, Homo sapiens
  misc_feature (19)..(20): n is a, c, g, or t
  misc_feature (23)..(23): n is a, c, g, or t
  misc_feature (25)..(25): n is a, c, g, or t
  misc_feature (30)..(30): n is a, c, g, or t
ctagaggtgtccccagggnnatncngtgtncgtatcagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacagaatccccgtgggactcctctagactcactca

SEQ ID NO: 731515 - DNA, 790 bp, Homo sapiens
  misc_feature (19)..(20): n is a, c, g, or t
  misc_feature (23)..(23): n is a, c, g, or t
  misc_feature (25)..(25): n is a, c, g, or t
  misc_feature (30)..(30): n is a, c, g, or t
ctagaggtgtccccagggnnatncngtgtncgtatcagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataactgtgtcatttggctttccagtcataccaactttagcagaatcaaaatgacctcaccatttttgttctagggt

SEQ ID NO: 731516 - DNA, 1988 bp, Homo sapiens
atatataggtacgcttgatgccacaaattttttaaaaaattgtccattttgttgcgtgtgcacctcttgccataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggattttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataactgtgtcatttggctttccagtcataccaactttagcagaatcaaaatgacctcaccatttttgttctagggt

SEQ ID NO: 731517 - DNA, 1861 bp, Homo sapiens
atatataggtacgcttgatgccacaaattttttaaaaaattgtccattttgttgcgtgtgcacctcttgccataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggattttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacagaatccccgtgggactcctctagactcactca

SEQ ID NO: 731518 - DNA, 1456 bp, Homo sapiens; identical to SEQ ID NO: 72588
  misc_feature (542)..(542): n is a, c, g, or t

SEQ ID NO: 731519 - DNA, 2933 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggactcagggactcaggccagtcaccctgtgaccgcaggttgctttcccaccctgggcaatgcagtgcagcatgggaaaggaataagggggcaacaaggtgcacagacctcagagatggcttccttgtttatggggctctcacagatacccatccaactcctctagtcagcactagatcatgggatcctaaaataaaccttggaaaaat

SEQ ID NO: 731520 - DNA, 3383 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactactcaaggtacaatttatcctgagtccaactgttcttgctgcgaacctaggaaatcaaacatgttatgtgcttccaaaatacagtggttggagaggcataggataaacattcccattc

SEQ ID NO: 731521 - DNA, 3538 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731522 - DNA, 3484 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731523 - DNA, 3329 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactactcaaggtacaatttatcctgagtccaactgttcttgctgcgaacctaggaaatcaaacatgttatgtgcttccaaaatacagtggttggagaggcataggataaacattcccattc

SEQ ID NO: 731524 - DNA, 3485 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaaggggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731525 - DNA, 3431 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaaggggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731526 - DNA, 3483 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaattaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731527 - DNA, 1196 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcaggttgccatggttggaatggggggttcctttctgtggaggactcagggaaaggggtttggatgggcattaggatttgaag

SEQ ID NO: 731528 - DNA, 3429 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaattaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731529 - DNA, 840 bp, Homo sapiens
atgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731530 - DNA, 3560 bp, Homo sapiens
  misc_feature (3537)..(3538): n is a, c, g, or t
  misc_feature (3541)..(3541): n is a, c, g, or t
  misc_feature (3549)..(3549): n is a, c, g, or t
  misc_feature (3554)..(3555): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaaggggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataaaaaaaaaaaaaaaaaaaaaaaaaaaaaaaaaaaaaaaaaaaaaaaaaaaaannaanaaaaaaanaaaannaaaaa

SEQ ID NO: 731531 - DNA, 3613 bp, Homo sapiens
  misc_feature (3590)..(3591): n is a, c, g, or t
  misc_feature (3594)..(3594): n is a, c, g, or t
  misc_feature (3602)..(3602): n is a, c, g, or t
  misc_feature (3607)..(3608): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataaaaaaaaaaaaaaaaaaaaaaaaaaaaaaaaaaaaaaaaaaaaaaaaaaaaannaanaaaaaaanaaaannaaaaa

SEQ ID NO: 731532 - DNA, 1470 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731533 - DNA, 3380 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731534 - DNA, 3455 bp, Homo sapiens
  misc_feature (3432)..(3433): n is a, c, g, or t
  misc_feature (3436)..(3436): n is a, c, g, or t
  misc_feature (3444)..(3444): n is a, c, g, or t
  misc_feature (3449)..(3450): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataaaaaaaaaaaaaaaaaaaaaaaaaaaaaaaaaaaaaaaaaaaaaaaaaaaaannaanaaaaaaanaaaannaaaaa

SEQ ID NO: 731535 - DNA, 3225 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactactcaaggtacaatttatcctgagtccaactgttcttgctgcgaacctaggaaatcaaacatgttatgtgcttccaaaatacagtggttggagaggcataggataaacattcccattc

SEQ ID NO: 731536 - DNA, 3327 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaaggggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731537 - DNA, 3325 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaattaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731538 - DNA, 3402 bp, Homo sapiens
  misc_feature (3379)..(3380): n is a, c, g, or t
  misc_feature (3383)..(3383): n is a, c, g, or t
  misc_feature (3391)..(3391): n is a, c, g, or t
  misc_feature (3396)..(3397): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaaggggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataaaaaaaaaaaaaaaaaaaaaaaaaaaaaaaaaaaaaaaaaaaaaaaaaaaaannaanaaaaaaanaaaannaaaaa

SEQ ID NO: 731539 - DNA, 3279 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactactcaaggtacaatttatcctgagtccaactgttcttgctgcgaacctaggaaatcaaacatgttatgtgcttccaaaatacagtggttggagaggcataggataaacattcccattc

SEQ ID NO: 731540 - DNA, 3379 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaattaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731541 - DNA, 3381 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaaggggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731542 - DNA, 3456 bp, Homo sapiens
  misc_feature (3433)..(3434): n is a, c, g, or t
  misc_feature (3437)..(3437): n is a, c, g, or t
  misc_feature (3445)..(3445): n is a, c, g, or t
  misc_feature (3450)..(3451): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaaggggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataaaaaaaaaaaaaaaaaaaaaaaaaaaaaaaaaaaaaaaaaaaaaaaaaaaaannaanaaaaaaanaaaannaaaaa

SEQ ID NO: 731543 - DNA, 3434 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataa

SEQ ID NO: 731544 - DNA, 3509 bp, Homo sapiens
  misc_feature (3486)..(3487): n is a, c, g, or t
  misc_feature (3490)..(3490): n is a, c, g, or t
  misc_feature (3498)..(3498): n is a, c, g, or t
  misc_feature (3503)..(3504): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataaaaaaaaaaaaaaaaaaaaaaaaaaaaaaaaaaaaaaaaaaaaaaaaaaaaannaanaaaaaaanaaaannaaaaa

SEQ ID NO: 731545 - DNA, 2325 bp, Homo sapiens
  misc_feature (2302)..(2303): n is a, c, g, or t
  misc_feature (2306)..(2306): n is a, c, g, or t
  misc_feature (2314)..(2314): n is a, c, g, or t
  misc_feature (2319)..(2320): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaaaaaaaaaaaaaaaaaaaaaaaaaaaaaaaaaaaaaaaaaaaaaaaaaaaaannaanaaaaaaanaaaannaaaaa

SEQ ID NO: 731546 - DNA, 3559 bp, Homo sapiens
  misc_feature (3536)..(3537): n is a, c, g, or t
  misc_feature (3540)..(3540): n is a, c, g, or t
  misc_feature (3548)..(3548): n is a, c, g, or t
  misc_feature (3553)..(3554): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataaaaaaaaaaaaaaaaaaaaaaaaaaaaaaaaaaaaaaaaaaaaaaaaaaaaannaanaaaaaaanaaaannaaaaa

SEQ ID NO: 731547 - DNA, 3506 bp, Homo sapiens
  misc_feature (3483)..(3484): n is a, c, g, or t
  misc_feature (3487)..(3487): n is a, c, g, or t
  misc_feature (3495)..(3495): n is a, c, g, or t
  misc_feature (3500)..(3501): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaaggggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaataaaaaaaaaaaaaaaaaaaaaaaaaaaaaaaaaaaaaaaaaaaaaaaaaaaaannaanaaaaaaanaaaannaaaaa

SEQ ID NO: 731548 - DNA, 2429 bp, Homo sapiens
  misc_feature (2406)..(2407): n is a, c, g, or t
  misc_feature (2410)..(2410): n is a, c, g, or t
  misc_feature (2418)..(2418): n is a, c, g, or t
  misc_feature (2423)..(2424): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaaaaaaaaaaaaaaaaaaaaaaaaaaaaaaaaaaaaaaaaaaaaaaaaaaaaannaanaaaaaaanaaaannaaaaa

SEQ ID NO: 731549 - DNA, 8400 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttagggggaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcgtgcctgggaagccgtgcgcgtcccccggcggcggcagcagcgggaggcgaggggcgccaccgaggagccgagcccgccgagccgggcgctctatttcagcgggcgaggcgagcagctgcgagtcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggacgtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttctctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaaaaaaaaa

SEQ ID NO: 731550 - DNA, 1715 bp, Homo sapiens; identical to SEQ ID NO: 69241
  misc_feature (1508)..(1508): n is a, c, g, or t
  misc_feature (1517)..(1517): n is a, c, g, or t
  misc_feature (1526)..(1526): n is a, c, g, or t
  misc_feature (1531)..(1531): n is a, c, g, or t
  misc_feature (1534)..(1534): n is a, c, g, or t
  misc_feature (1537)..(1538): n is a, c, g, or t
  misc_feature (1542)..(1543): n is a, c, g, or t
  misc_feature (1546)..(1546): n is a, c, g, or t
  misc_feature (1562)..(1562): n is a, c, g, or t

SEQ ID NO: 731551 - DNA, 1690 bp, Homo sapiens
acaggacccaggtgctgggggagaacagacctcgggagcagccaggagtcctcggtcctgggagggtttaaaagccagggggccgtctcgacctcagtctgaccttccctcccggcagcagcatgcgggggttgctggtgttgagtgtcctgttgggggctgtctttggcaaggaggactttgtggggcatcaggtgctccgaatctctgtagccgatgaggcccaggtacagaaggtgaaggagctggaggacctggagcacctgcagctggacttctggcggggccctgcccaccctggctcccccatcgacgtccgagtgcccttccccagcatccaggcggtcaagatctttctggagtcccacggcatcagctatgagaccatgatcgaggacgtgcagtcgctgctggacgaggagcaggagcagatgttcgccttccggtcccgggcgcgctccaccgacacttttaactacgccacctaccacaccctggaggagatctatgacttcctggacctgctggtggcggagaacccgcaccttgtcagcaagatccagattggcaacacctatgaagggcgtcccatttacgtgctgaagttcagcacggggggcagtaagcgtccagccatctggatcgacacgggcatccattcccgggagtgggtcacccaggccagtggggtctggtttgcaaagaagatcactcaagactacgggcaggatgcagctttcaccgccattctcgacaccttggacatcttcctggagatcgtcaccaaccctgatggctttgccttcacgcacagcacgaatcgcatgtggcgcaagactcggtcccacacagcaggctccctctgtattggcgtggaccccaacaggaactgggacgctggctttgggttgtccggagccagcagtaacccctgctcggagacttaccacggcaagtttgccaattccgaagtggaggtcaagtccattgtagactttgtgaaggaccatgggaacatcaaggccttcatctccatccacagctactcccagctcctcatgtatccctatggctacaaaacagaaccagtccctgaccaggatgagctggatcagctttccaaggctgctgtgacagccctggcctctctctacgggaccaagttcaactatggcagcatcatcaaggcaatttatcaagccagtggaagcactattgactggacctacagccagggcatcaagtactccttcaccttcgagctccgggacactgggcgctatggcttcctgctgccagcctcccagatcatccccacagccaaggagacgtggctggcgcttctgaccatcatggagcacaccctgaatcacccctactgagctgaccctttgacacccttcttgtcctcctctctggccccatccaggcaaccaaataaagtttgagtgtaccaggaacagaatcctggggcttgcaaaaaaaaaaaaaaaaaaaaaaaaaaaaatggttgggggggcccgggccccggaaaaagttttaaacctccttttggggccgcccgcccccttggttttggactggccacgcggcccacgaagccgggtctgcacggggtgggtctccccaaaaacgcccgggggcccgcgcttggcacacccggggccgcggctcggttcacgggccggct

SEQ ID NO: 731552 - DNA, 377 bp, Homo sapiens; identical to SEQ ID NO: 69242

SEQ ID NO: 731553 - DNA, 1262 bp, Homo sapiens
ctcagagccttcctgatgtatatatgcaggtagtgagaattgaatcggccctttgagacagtaatataataaaactctgatttggggagcagcggttctccttatttttctactctcttgtgggaatgagttgccaagcttttacttcggctgatacctttatacctctgaattctgacgcctctgcaactctgcctctgataatgcatcacagtgctgccgagtgtctaccagtctccaaccatgccaccaatgtgatgtctacagcaacaggacttcattattctgttccttcctgtcattatggaaaccagccatcaacctatggagtgatggcaggtagtttaaccccttgtctttataaatttcctgaccacaccttgagtcatggatttcctcctatacaccagcctcttctggcagaggaccccacagctgctgatttcaagcaggaactcaggcggaaaagtaaattggtggaagagccaatagacatggattctccagaaatcagagaacttgaaaagtttgccaatgaatttaaagtgagacgaattaaattaggatacacccagacaaatgttggggaggccctggcagctgtgcatggctctgaattcagtcaaacaacaatctgccgatttgaaaatctgcagctcagctttaaaaatgcatgcaaactgaaagcaatattatccaaatggctggaggaagctgagcaagtaggagctttgtacaatgaaaaagtgggagcaaatgaaaggaaaagaaaacgaagaacaactataagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcagataagatttttctattgtataatagcctttttctcccgtttcattcctttctcttcctcaacaaaaacagaaattacttggttgacttaaaatcattttatatcaatagcttttacagaagctttacttttccacttttttttaaaaaaaagaaaccaacaatttaaattatattgatgttatttacttaaaataattattctcagaagccacattatctattttaagccaaatatattaacagtaataaaatgatctctctgtc

SEQ ID NO: 731554 - DNA, 1493 bp, Homo sapiens; identical to SEQ ID NO: 417481

SEQ ID NO: 731555 - DNA, 85 bp, Homo sapiens
  misc_feature (5)..(5): n is a, c, g, or t
tctanagtcccatctattttgtctttgatccaaactcctaaatgtttgtgcacacatttctcggtgacaacgttgggaaacacag

SEQ ID NO: 731556 - DNA, 465 bp, Homo sapiens
agccctccaggacaggctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccccacccgccgcctcctgcaccgagagagatggaataaagcccttgaaccagc

SEQ ID NO: 731557 - DNA, 320 bp, Homo sapiens
ctggcgggcaggcgggcactgtgtctccctgactgtgtcctcctgtgtccctctgcctcgccgctgttccggaacctgctctgcgcggcacgtcctggcagtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccccacccgccgcctcctgcaccgagagagatggaataaagcccttgaaccagc

SEQ ID NO: 731558 - DNA, 1582 bp, Homo sapiens; identical to SEQ ID NO: 418011
  misc_feature (8)..(8): n is a, c, g, or t
  misc_feature (11)..(11): n is a, c, g, or t

SEQ ID NO: 731559 - DNA, 295 bp, Homo sapiens
tttcctgactacttgccctgttcagtgatgttgcagccagctccacaagattcagggaagtcctgtggggttgactttgaggtcaaagcattcgccacagacagcaccgatgccgaagaggacaaaatccccaagaagagctccgtgcgattactgatccgcaaagtacagcatgccccacttgagatgggtccccagccccgagctgaggcggcctggcagttcttcatgtctgacaagcccctgcaccttgcggtctctctcaacaaagaggtaaccacctaccatcgctact

SEQ ID NO: 731560 - DNA, 261 bp, Homo sapiens
ctcaggaggaggctgtggtctctgactcttgagccagtttgtctcattaactccatagaacattctagaaattcagcaattcagaataggctgagttgcttgaagaaatatcctcctgttgctgccagcccaccctgagatttcacaagcactgttctgcttctcagaaaaagtgccaccaaacagcactttgaccaagacgctgacgctgctgcccttgctggctaacaatcgagaaaggagaggcattgccctggatgg

SEQ ID NO: 731561 - DNA, 916 bp, Homo sapiens
  misc_feature (8)..(8): n is a, c, g, or t
  misc_feature (11)..(11): n is a, c, g, or t
gggatctngcnagatcccctacaaattccccacatacgtaggccaggagcctcagcggtgccccttcaggctcatctggcaagacggtaccagcttgctcagaacaggggctggctattcatcatctcagagcatagagaccctctccttgccacccggcccttcccacctggttggtgacaaatcacaaggattgtcttacctttctccaaccctctaacacctgaccaacaccccaaggtggtagaagttgccagggacagataacatggcagccagcgggaagaccagcaagtccgaaccgaaccatgttatcttcaagaagatctcccgggacaaatcggtgaccatctacctggggaacagagactacatagaccatgtcagccaagtccagcctgtggatggtgtcgtgttggttgatcctgatcttgtgaagggaaagaaagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacgtttcctgactacttgccctgttcagtgatgttgcagccagctccacaagattcagggaagtcctgtggggttgactttgaggtcaaagcattcgccacagacagcaccgatgccgaagaggacaaaatccccaagaagagctccgtgcgattactgatccgcaaagtacagcatgccccacttgagatgggtccccagccccgagctgaggcggcctggcagttcttcatgtctgacaagcccctgcaccttgcggtctctctcaacaaagag

SEQ ID NO: 731562 - DNA, 464 bp, Homo sapiens; identical to SEQ ID NO: 418017

SEQ ID NO: 731563 - DNA, 1584 bp, Homo sapiens
  misc_feature (394)..(394): n is a, c, g, or t
cggggcagctctgaggaacaaggtggaagctcagagcgctggtctccaccctggtgcccctgggctggtgctggcagtgggagccgtggctgtggatgagagacatagacgagagagtgagatggcctggtttgccctctacctcctgagccttctctgggctacagctgggactagtacccagacccagagttcatgctccgttccctcagcacaggagcccttggtcaatggaatacaagtactcatggagaactcggtgacttcatcagcctacccaaaccccagcatcctgattgccatgaatctggccggagcctacaacttgaaggcccagaagctcctgacttaccagctcatgtccagcgacaacaacgatctaaccattgggcanctcggcctcaccatcatggccctcacctcctcctgccgagaccctggggataaagtatccattctacaaagacaaatggagaactgggcaccttccagccccaacgctgaagcatcagccttctatgggcccagtctagcgatcttggcactgtgccagaagaactctgaggcgaccttgccgatagccgtccgctttgccaagaccctgctggccaactcctctcccttcaatgtagacacaggagcaatggcaaccttggctctgacctgtatgtacaacaagatccctgtaggttcagaggaaggttacagatccctgtttggtcaggtactaaaggatattgtggagaaaatcagcatgaagatcaaagataatggcatcattggagacatctacagtactggcctcgccatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaacgaagaggtgggttcagcttctatcaaacatctccaaaggatgggtgaaattttttccacttcattttaaatctatgcaaaaaagcgaatgcctgtgatgctaccatattcctggtaaaaacatggagaaccactatgtagaataaaaatgcaaagttcactggagtctcaacatctatgactcatgaaaataaaattttcatcttctc

SEQ ID NO: 731564 - DNA, 989 bp, Homo sapiens
  misc_feature (31)..(31): n is a, c, g, or t
tagaggatccccatgcgcgacgcttccatcnatgtagacacaggagcaatggcaaccttggctctgacctgtatgtacaacaagatccctgtaggttcagaggaaggttacagatccctgtttggtcaggtactaaaggatattgtggagaaaatcagcatgaagatcaaagataatggcatcattggagacatctacagtactggcctcgccatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaacgaagaggtgggttcagcttctatcaaacatctccaaaggatgggtgaaattttttccacttcattttaaatctatgcaaaaaagcgaatgcctgtgatgctaccatattcctggtaaaaacatggagaaccactatgtagaataaaaatgcaaagttcactggagtctcaacatctatgactcatgaaaataaaattttcatcttctc

SEQ ID NO: 731565 - DNA, 2775 bp, Homo sapiens; identical to SEQ ID NO: 81519

SEQ ID NO: 731566 - DNA, 1964 bp, Homo sapiens; identical to SEQ ID NO: 81284
  misc_feature (494)..(494): n is a, c, g, or t

SEQ ID NO: 731567 - DNA, 712 bp, Homo sapiens
ggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtaacagctttggtttaataccctaccgccggcccatcaccactgtgggtaagtccaggaccaggctgggagggaggaggccaaagggacagggcaggttgtgtgctgcaaggggacatggagatgagccagatttattcctgccctaatggggctcacattctagactgggaaacatacacatacaagcagatagaatagaagacagtctgggataggaactatagcagaggtgccaacagcaatagttgtgactaattgctgagcacctgctgtgtgccaggcactacactagctgccctacatgaagcaactcagcttatcctaacaatcttcatggcaggatttttttttaagagttttgctcttgtcgctcagcctgga

SEQ ID NO: 731568 - DNA, 1819 bp, Homo sapiens
ctacaaggaggcaggcaagacagcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagagaacatggagacttttacccttttgatggacctggaaatgttttggcccatgcctatgcccctgggccagggattaatggagatgcccactttgatgatgatgaacaatggacaaaggatacaacagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggacctccccctgactcccctgagacccccctggtacccacggaacctgtccctccagaacctgggacgccagccaactgtgatcctgctttgtcctttgatgctgtcagcactctgaggggagaaatcctgatctttaaagacaggcacttttggcgcaaatccctcaggaagcttgaacctgaattgcatttgatctcttcattttggccatctcttccttcaggcgtggatgccgcatatgaagttactagcaaggacctcgttttcatttttaaaggaaatcaattctgggctatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagtta

SEQ ID NO: 731569 - DNA, 1430 bp, Homo sapiens
ctacaaggaggcaggcaagacagcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagagaacatggagacttttacccttttgatggacctggaaatgttttggcccatgcctatgcccctgggccagggattaatggagatgcccactttgatgatgatgaacaatggacaaaggatacaacagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggacctccccctgactcccctgagacccccctggtacccacggaacctgtccctccagaacctgggacgccagccaactgtgatcctgctttgtcctttgatgctgtcagcactctgaggggagaaatcctgatctttaaagacaggcacttttggcgcaaatccctcaggaagcttgaacctgaattgcatttgatctcttcattttggccatctcttccttcaggcgtggatgccgcatatgaagttactagcaaggacctcgttttcatttttaaaggaaatcaattctgggctatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgacagagctggcaccgagtgctgtctccattct

SEQ ID NO: 731570 - DNA, 463 bp, Homo sapiens
aagaacaaaacatatttctttgtagaggacaaatactggaggtgagatgcaagagaaatgactttgtatggagcctaattagggaaattagtttcttttactaaggaaatcccccaccccaaccttaggcctgcttctctcttagtaggaaggatgggacttcagacaactgtgggaaagttcttactttaaaacagcagcaccttaggctctcctgctttcagtcccaagtgcagttggctggtgcttcccttggtgctgtcaccccacctgcctggagccccctcttctctcctcaacctattcaaatcttgcccatccttcaagtcctggctcaagtctcatcacctccatgcagctttccctcgtggactttagacccattgggaaaatgttctgagaacccagaccgcaatttagcgttcccttcccattgtcttttagtttggctcactgtctcact

SEQ ID NO: 731571 - DNA, 538 bp, Homo sapiens; identical to SEQ ID NO: 458306

SEQ ID NO: 731572 - DNA, 852 bp, Homo sapiens
  misc_feature (772)..(772): n is a, c, g, or t
  misc_feature (783)..(783): n is a, c, g, or t
  misc_feature (800)..(800): n is a, c, g, or t
gctagagcaggccaggtcatctttgggtggtggagtgcaaaggaggcgacctgcaacagaggagtcccggtcaccagcaaccatgacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaaaaaaaaaaaaaaaaaaaactttgggggcgcggcccgaaaaattttaaacattctgtggggcgggcccaggaangacatggccanggccaagaaccggcganagggggtcccaaaaaaccgggcacgtggaacccaaggtcggctggttaagcc

SEQ ID NO: 731573 - DNA, 699 bp, Homo sapiens; identical to SEQ ID NO: 325648

SEQ ID NO: 731574 - DNA, 1086 bp, Homo sapiens
  misc_feature (127)..(127): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (140)..(140): n is a, c, g, or t
  misc_feature (144)..(144): n is a, c, g, or t
  misc_feature (146)..(146): n is a, c, g, or t
  misc_feature (161)..(162): n is a, c, g, or t
  misc_feature (1006)..(1006): n is a, c, g, or t
  misc_feature (1017)..(1017): n is a, c, g, or t
  misc_feature (1034)..(1034): n is a, c, g, or t
gcatgccctgtgaccaggcagggatgggctatgtcgctgttggggaccacgagggatggccagtgaggaggggtcagaggctgtgaggggaggactgaggctgggtgtggtgtcctgggatggaagnggagancnaancngatnanagacggcgacaagannaacgacggccgcattgacttcgacgagttcctgaagatgatggagggcgtgcagtaaggagtggacagtcgcctctaccaagatcgcgtgtccctagggtggtggagtgcaaaggaggcgacctgcaacagaggagtcccggtcaccagcaaccatgacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaaaaaaaaaaaaaaaaaaaactttgggggcgcggcccgaaaaattttaaacattctgtggggcgggcccaggaangacatggccanggccaagaaccggcganagggggtcccaaaaaaccgggcacgtggaacccaaggtcggctggttaagcc

SEQ ID NO: 731575 - DNA, 933 bp, Homo sapiens; identical to SEQ ID NO: 325647
  misc_feature (127)..(127): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (140)..(140): n is a, c, g, or t
  misc_feature (144)..(144): n is a, c, g, or t
  misc_feature (146)..(146): n is a, c, g, or t
  misc_feature (161)..(162): n is a, c, g, or t

SEQ ID NO: 731576 - DNA, 353 bp, Homo sapiens; identical to SEQ ID NO: 325646
  misc_feature (127)..(127): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (140)..(140): n is a, c, g, or t
  misc_feature (144)..(144): n is a, c, g, or t
  misc_feature (146)..(146): n is a, c, g, or t
  misc_feature (161)..(162): n is a, c, g, or t

SEQ ID NO: 731577 - DNA, 933 bp, Homo sapiens
  misc_feature (853)..(853): n is a, c, g, or t
  misc_feature (864)..(864): n is a, c, g, or t
  misc_feature (881)..(881): n is a, c, g, or t
gggcccttggctccaggagggacttgggaagcctgggtcggcctgagggagtcccaggcctgccgcagagtcatcccagtccggccagtgttcacaggcttgcacaatctgatttgaacctcacacatgggaagtaggcaaacagggaaactgaggaccagagaggacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaaaaaaaaaaaaaaaaaaaactttgggggcgcggcccgaaaaattttaaacattctgtggggcgggcccaggaangacatggccanggccaagaaccggcganagggggtcccaaaaaaccgggcacgtggaacccaaggtcggctggttaagcc

SEQ ID NO: 731578 - DNA, 780 bp, Homo sapiens; identical to SEQ ID NO: 325649

SEQ ID NO: 731579 - DNA, 825 bp, Homo sapiens; identical to SEQ ID NO: 390032

SEQ ID NO: 731580 - DNA, 859 bp, Homo sapiens; identical to SEQ ID NO: 390033

SEQ ID NO: 731581 - DNA, 712 bp, Homo sapiens
aagtcaagggccggctggcaaccccagcaagctgtcctgtgagccgccagcatggatgacatctacaaggctgcggtagagcagctgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaacaacgacggccgcatcgactatgatgagttcctggagttcatgaagggtgtggagtagatgctgaccttcacccagagctgcctatgcccagcctccaactccagctgagtcctggggttggggagggggtcggggtcccaggacctgagcctggccatgtcctcaaccccaaatcccccgactccctccccagatctgtcctgggggatgcaaataaagcctgctctcccaa

SEQ ID NO: 731582 - DNA, 428 bp, Homo sapiens
cagtggccaccctggtcaggttaccgtgggtggcttgcctgcctccacactggttttattatcccaacttgagggacagctgtccttcgggccacccagcttgagtttcatcaggggccgaaagggcattgagtggtcactgactattgttactgagggtcaccttggtcctgaagggggtgcccacctgtcaccctggccctgagcccagtcgcagtgaggccagctgggtcacgtcagggctttgggggcagggagggaggactgagacctccactctgtggcctggaaatagcctgcctcctccagctccagccttctcacctgtggaatgggttggtttcctcagcagcagctatacctgagtctgagccttgagattccctttcctttctaggtagagcagctgacagaagagcagaaaaatg

SEQ ID NO: 731583 - DNA, 302 bp, Homo sapiens
aagtcaagggccggctggcaaccccagcaagctgtcctgtgagccgccagcatggatgacatctacaaggctgcggtagagcagctgacagaagagcagaaaaatgagttcaaggcagccttcgacatcttcgtgctgggcgctgaggatggctgcatcagcctccaactccagctgagtcctggggttggggagggggtcggggtcccaggacctgagcctggccatgtcctcaaccccaaatcccccgactccctccccagatctgtcctgggggatgcaaataaagcctgctctcccaa

SEQ ID NO: 731584 - DNA, 618 bp, Homo sapiens
aagtcaagggccggctggcaaccccagcaagctgtcctgtgagccgccagcatggatgacatctacaaggctgcggtagagcagctgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaacaacgacggccgcatcgactatgatgagttcctggagttcatgaagggtgtggagtagatgctgaccttcacccagagctgcctatgcccagctccccagatctgtcctgggggatgcaaataaagcctgctctcccaa

SEQ ID NO: 731585 - DNA, 1797 bp, Homo sapiens
tgttgcatacagatgagttggcagccggtctgagctggcccacagactcataaaatcaacagggcctcgggtaccctcacccagcatatccaaactcttgcatcaaaggtgcagggacttgctcacatcgagaatctggttgctttcttggagaccaagaaaatgagtttttgtttctacatttactccagcaatccatgaggactttataggaattttgcaccattctgaatggatacatttggatttctcaacatttgttcagcttcctaatgactgttgtgacaattgctctataccagtgaatgccaactgtttatctctgctctgaacagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggc

SEQ ID NO: 731586 - DNA, 1664 bp, Homo sapiens
tgttgcatacagatgagttggcagccggtctgagctggcccacagactcataaaatcaacagggcctcgggtaccctcacccagcatatccaaactcttgcatcaaaggtgcagggacttgctcacatcgagaatctggttgctttcttggagaccaagaaaatgagtttttgtttctacatttactccagcaatccatgagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggc

SEQ ID NO: 731587 - DNA, 2543 bp, Homo sapiens
tgttgcatacagatgagttggcagccggtctgagctggcccacagactcataaaatcaacagggcctcgggtaccctcacccagcatatccaaactcttgcatcaaaggtgcagggacttgctcacatcgagaatctggttgctttcttggagaccaagaaaatgagtttttgtttctacatttactccagcaatccatgaggactttataggaattttgcaccattctgaatggatacatttggatttctcaacatttgttcagcttcctaatgactgttgtgacaattgctctataccagtgaatgccaactgtttatctctgctctgaacagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttc

SEQ ID NO: 731588 - DNA, 2227 bp, Homo sapiens
gaggcactaaagaaaaagtggcagtaatgtaatccgcttgttttgccaagccactaaaaataccttggtaaatattagctaatgtgcagccctttgcttgctattaagatttactgatttcaatagaaaggaacctaaaaactgagcatattatataacccagacaccagggacaatctctaatcacctaagagttcataaaatacatattggctctgtctgtggttagattaaatgccattatctaaaaaaagtaggatctgtgcaataataggtctgccatgtgaatgacagttttggttagtggatgaatttatcctgtatcattgcattctctaagaataatccctctcactctgaacaaataaatcaatagcattggctaacccagtgcatgtaaaaaacaccttcagtaaatgccaggttttcccgaataataaagacttccaacaataaagacttcttttaagtctgtttcttacataactgttgtatggagagattaacatggtatcttgtttcttcctggtgtgatcttacttttgtcttgtaaatatgtacttatgtctgtatgttcacctgtatctttgtgaacccttggaaaactcagtatttcagtgggtttcagagaataggccgggagattgatgataagtaagtgtttccggccagttgttattaggcacaacttttaggagaaacaagtgagcgatagagcgtggccaaggagaggaaggcaatgctggaacccaatccacgcctgctgcccagagaccttagctgatggcttgtcatgtcttagcatgttggtattcaagccatgtgatgttggaaagaaaaaatacctattcagcttggggcttggtctgagaacaaccaattgccttggtttaaatcacacgactccactatcaaattaagtgtttccaagtttacacaaattagcgtcagtccactgactgtcgcctacaataaattaggctgagtctaaaagaaatcagtctgcatagaaagaccaacaaccagcaccacttccttgctttttccagccatgaatgcttccagtcggaatgtgtttgacacgttgatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaa

SEQ ID NO: 731589 - DNA, 867 bp, Homo sapiens
tgttgcatacagatgagttggcagccggtctgagctggcccacagactcataaaatcaacagggcctcgggtaccctcacccagcatatccaaactcttgcatcaaaggtgcagggacttgctcacatcgagaatctggttgctttcttggagaccaagaaaatgagtttttgtttctacatttactccagcaatccatgaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggcc

SEQ ID NO: 731590 - DNA, 1000 bp, Homo sapiens
tgttgcatacagatgagttggcagccggtctgagctggcccacagactcataaaatcaacagggcctcgggtaccctcacccagcatatccaaactcttgcatcaaaggtgcagggacttgctcacatcgagaatctggttgctttcttggagaccaagaaaatgagtttttgtttctacatttactccagcaatccatgaggactttataggaattttgcaccattctgaatggatacatttggatttctcaacatttgttcagcttcctaatgactgttgtgacaattgctctataccagtgaatgccaactgtttatctctgctctgaacaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggcc

SEQ ID NO: 731591 - DNA, 3346 bp, Homo sapiens
gaggcactaaagaaaaagtggcagtaatgtaatccgcttgttttgccaagccactaaaaataccttggtaaatattagctaatgtgcagccctttgcttgctattaagatttactgatttcaatagaaaggaacctaaaaactgagcatattatataacccagacaccagggacaatctctaatcacctaagagttcataaaatacatattggctctgtctgtggttagattaaatgccattatctaaaaaaagtaggatctgtgcaataataggtctgccatgtgaatgacagttttggttagtggatgaatttatcctgtatcattgcattctctaagaataatccctctcactctgaacaaataaatcaatagcattggctaacccagtgcatgtaaaaaacaccttcagtaaatgccaggttttcccgaataataaagacttccaacaataaagacttcttttaagtctgtttcttacataactgttgtatggagagattaacatggtatcttgtttcttcctggtgtgatcttacttttgtcttgtaaatatgtacttatgtctgtatgttcacctgtatctttgtgaacccttggaaaactcagtatttcagtgggtttcagagaataggccgggagattgatgataagtaagtgtttccggccagttgttattaggcacaacttttaggagaaacaagtgagcgatagagcgtggccaaggagaggaaggcaatgctggaacccaatccacgcctgctgcccagagaccttagctgatggcttgtcatgtcttagcatgttggtattcaagccatgtgatgttggaaagaaaaaatacctattcagcttggggcttggtctgagaacaaccaattgccttggtttaaatcacacgactccactatcaaattaagtgtttccaagtttacacaaattagcgtcagtccactgactgtcgcctacaataaattaggctgagtctaaaagaaatcagtctgcatagaaagaccaacaaccagcaccacttccttgctttttccagccatgaatgcttccagtcggaatgtgtttgacacgttgatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtgaaaaaaaaaaagat

SEQ ID NO: 731592 - DNA, 751 bp, Homo sapiens; identical to SEQ ID NO: 384346
  misc_feature (46)..(48): n is a, c, g, or t

SEQ ID NO: 731593 - DNA, 1630 bp, Homo sapiens
  misc_feature (46)..(48): n is a, c, g, or t
ccgtcagaaatctaaacccgtgactatcatgggactcaaaaccagnnnaaaaaataagtcaaagacgattaagagccagagaagcagtcttcatacacgcggccagccagcagacagaggactctcattaaggaaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctggatcctatatcttaggtaagacatataacgcagtctaattacatttcacttcaaggctcaatgctattctaactaatgacaagtattttctactaaaccagaaattggtagaaggatttaaataagtaaaagctactatgtactgccttagtgctgatgcctgtgtactgccttaaatgtacctatggcaatttagctctcttgggttcccaaatccctctcacaagaatgtgcagaagaaatcataaaggatcagagattc

SEQ ID NO: 731594 - DNA, 909 bp, Homo sapiens
  misc_feature (46)..(48): n is a, c, g, or t
ccgtcagaaatctaaacccgtgactatcatgggactcaaaaccagnnnaaaaaataagtcaaagacgattaagagccagagaagcagtcttcatacacgcggccagccagcagacagaggactctcattaaggaaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcagcacaaaaaaaacgaaaaaaaaatctttgggccgccggcccggaaagttttaaccatttttgggggcggccccagtaaaaacgggcacggtccaaaccgcggaggggttccaaaaaccgggacgggtgaaaccccggcggctggtccaggccctcacccgg

SEQ ID NO: 731595 - DNA, 645 bp, Homo sapiens; identical to SEQ ID NO: 384344
  misc_feature (46)..(48): n is a, c, g, or t

SEQ ID NO: 731596 - DNA, 2222 bp, Homo sapiens
gtaagagcgttgccttctcgccataatcatagtcctcttctcccagaataggatttgggaaattctggctaagtcctctgcctaccctcattgccccgctgatgtgtgacatcaacagaatttctccgcaacgtttgtcagtctccaacctcagagggctcacaaagcctcctcctgaatcctctctcagtcctccaacactaccaagaagaaaagcaattattcaggatggcatcttgctggggagaagcagcctccctgaggtagatgtgttctcctgtcacttaaagaaccacttctcctggtctgagtagtaagaggcgcatttgctgttgctgcaccatttgccaaggctctgagtttgaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctggatcctatatcttaggtaagacatataacgcagtctaattacatttcacttcaaggctcaatgctattctaactaatgacaagtattttctactaaaccagaaattggtagaaggatttaaataagtaaaagctactatgtactgccttagtgctgatgcctgtgtactgccttaaatgtacctatggcaatttagctctcttgggttcccaaatccctctcacaagaatgtgcagaagaaatcataaaggatcagagattctggaatggtgtcattatttgcatagcaacattgcaatttgttttcctttggctacatcaacgtatcacctacactattatttatctaatatttctctttcaggcagctcatttaaactttttttggctttaattcctattgccatcctgagtggaaaaccagtatcattttccatagtagaggataactataacaacgaagataatgaaagtaatttttttaacctaagaaaatactaatggtcacagaaggctatgaacctgagacctgctctctttgtcaaacagagattaacaaggatcagagaaaagttaaaggctgtctttgacataactggaaggcttacaagagttttaaagaaa

SEQ ID NO: 731597 - DNA, 1860 bp, Homo sapiens
gtaagagcgttgccttctcgccataatcatagtcctcttctcccagaataggatttgggaaattctggctaagtcctctgcctaccctcattgccccgctgatgtgtgacatcaacagaatttctccgcaacgtttgtcagtctccaacctcagagggctcacaaagcctcctcctgaatcctctctcagtcctccaacactaccaagaagaaaagcaattattcaggatggcatcttgctggggagaagcagcctccctgaggtagatgtgttctcctgtcacttaaagaaccacttctcctggtctgagtagtaagaggcgcatttgctgttgctgcaccatttgccaaggctctgagtttgaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctggatcctatatcttaggtaagacatataacgcagtctaattacatttcacttcaaggctcaatgctattctaactaatgacaagtattttctactaaaccagaaattggtagaaggatttaaataagtaaaagctactatgtactgccttagtgctgatgcctgtgtactgccttaaatgtacctatggcaatttagctctcttgggttcccaaatccctctcacaagaatgtgcagaagaaatcataaaggatcagagattc

SEQ ID NO: 731598 - DNA, 1992 bp, Homo sapiens
  misc_feature (46)..(48): n is a, c, g, or t
ccgtcagaaatctaaacccgtgactatcatgggactcaaaaccagnnnaaaaaataagtcaaagacgattaagagccagagaagcagtcttcatacacgcggccagccagcagacagaggactctcattaaggaaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctggatcctatatcttaggtaagacatataacgcagtctaattacatttcacttcaaggctcaatgctattctaactaatgacaagtattttctactaaaccagaaattggtagaaggatttaaataagtaaaagctactatgtactgccttagtgctgatgcctgtgtactgccttaaatgtacctatggcaatttagctctcttgggttcccaaatccctctcacaagaatgtgcagaagaaatcataaaggatcagagattctggaatggtgtcattatttgcatagcaacattgcaatttgttttcctttggctacatcaacgtatcacctacactattatttatctaatatttctctttcaggcagctcatttaaactttttttggctttaattcctattgccatcctgagtggaaaaccagtatcattttccatagtagaggataactataacaacgaagataatgaaagtaatttttttaacctaagaaaatactaatggtcacagaaggctatgaacctgagacctgctctctttgtcaaacagagattaacaaggatcagagaaaagttaaaggctgtctttgacataactggaaggcttacaagagttttaaagaaa

SEQ ID NO: 731599 - DNA, 1478 bp, Homo sapiens; identical to SEQ ID NO: 637764
  misc_feature (132)..(132): n is a, c, g, or t
  misc_feature (846)..(846): n is a, c, g, or t
  misc_feature (866)..(866): n is a, c, g, or t
  misc_feature (870)..(870): n is a, c, g, or t
  misc_feature (885)..(885): n is a, c, g, or t
  misc_feature (888)..(888): n is a, c, g, or t
  misc_feature (915)..(915): n is a, c, g, or t

SEQ ID NO: 731600 - DNA, 6029 bp, Homo sapiens
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t
ctcagaggctgctgagggacagggcactcttccccgccgtccacacaatgagtgttggccggaggaagctggccctgctctgggccctggctctcgctctggcctgcacccggcatacagccatgcccaggatggctcctccgaatccagctacaagcaccaccctgccctctctcctatcgcccgggggcccancggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggangccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgangaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgngcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggangttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccngggncacaggggctggctgtcagaagagctgccacacactggacatgacctgttacagcccccantgtgtgcctggctgcgtgtgccccgacgggctggtggcggacggcgagggcggctgcatcactgcggaggactgcccctgcgtgcacaatnaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacncgctggtgcagaaccnctgtggcgggaaagacagcacccaggactcctttcgtgttgtcaccgagaacgtcccctgcggcaccacagggaccacctgctccaaggccatcaagattttcctgggggncttcgagctgaagctaagccatnggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggcccgctacgcccaggcctgccatgaagtaggcacctgtgtgtgtctgcggaccccaagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcgctgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagccgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctagcctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgcccctacaaccagcacaatccctgcttctacacccagcacaacctctgcccctacaaccagcacaacctctgctcctacaaccagcatatcctctgcccctacaagcagcacaacctcggctcctacaagcagcacaatctctgctcgtacaaccagcataatctctgcccctacaaccagcacaacctctttccctacaaccagcacaacctctgctactacaaccagcacaacctctgcccctacaagcagcacaacctccactccacagaccagcaaaacctcagctg

SEQ ID NO: 731601 - DNA, 9415 bp, Homo sapiens
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t
  misc_feature (5765)..(5765): n is a, c, g, or t
  misc_feature (5785)..(5785): n is a, c, g, or t
  misc_feature (5789)..(5789): n is a, c, g, or t
  misc_feature (5804)..(5804): n is a, c, g, or t
  misc_feature (5807)..(5807): n is a, c, g, or t
  misc_feature (5834)..(5834): n is a, c, g, or t
ctcagaggctgctgagggacagggcactcttccccgccgtccacacaatgagtgttggccggaggaagctggccctgctctgggccctggctctcgctctggcctgcacccggcatacagccatgcccaggatggctcctccgaatccagctacaagcaccaccctgccctctctcctatcgcccgggggcccancggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggangccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgangaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgngcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggangttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccngggncacaggggctggctgtcagaagagctgccacacactggacatgacctgttacagcccccantgtgtgcctggctgcgtgtgccccgacgggctggtggcggacggcgagggcggctgcatcactgcggaggactgcccctgcgtgcacaatnaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacncgctggtgcagaaccnctgtggcgggaaagacagcacccaggactcctttcgtgttgtcaccgagaacgtcccctgcggcaccacagggaccacctgctccaaggccatcaagattttcctgggggncttcgagctgaagctaagccatnggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggcccgctacgcccaggcctgccatgaagtaggcacctgtgtgtgtctgcggaccccaagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcgctgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagccgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctagcctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgctcctacaaccagcacaacctctggtnctggaactactcccagcccngttnccaccaccagcacanccnctgtttcaaagaccagcacaagccatntttctgtatccaagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctctgtgaccccatatgggacttctcctaccaatgctctgtatccttccctgtctacttccatggtatccgcctccgtggcatccacctctgtggcatccagctctgtggcatccagctctgtggcttactccacccaaacctgcttctgcaacgtggctgaccggctctaccctgcaggatccaccatataccgccacagagacctcgctggccattgctattatgccctgtgtagccaggactgccaagtggtcagaggggttgacagtgactgtccgtccaccacgctgcctcctgccccagccacgtccccttcaatatccacctccgagcccgtcactgagctgggatgcccaaatgcggttccccccagaaagaaaggtgagacctgggccacacccaactgctccgaggccacctgtgagggcaacaacgtcatctccctgagcccgcgcacgtgcccgagggtggagaagcccacttgtgccaacggctacccggctgtgaaggtggctgaccaagatggctgctgccatcactaccagtgccagtgtgtgtgcagcggctggggtgacccccactacatcaccttcgacggcacctactacaccttcctggacaactgcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacaaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggcctctggaacgtgagcatccctgaccagccagcctgccaccggcctcacccgacgcccaccacggtcgggcccaccacagttgggtctaccacggtcgggcccaccacagttgggtctaccaccgtcgggcccaccacaccgcctgctccgtgcctgccatcacccatctgccacctgattctgagcaaggtctttgagccgtgccacactgtgatccccccactgctgttctatgagggctgcgtctttgaccggtgccacatgacggacctggatgtggtgtgctccagcctggagctgtacgcggcactctgcgcgtcccacgacatctgcatcgattggagaggccggaccggccacatgtgcccattcacctgcccagccgacaaggtgtaccagccctgcggcccgagcaacccctcctactgctacgggaatgacagcgccagcctcggggctctccgggaggccggccccatcaccgaaggctgcttctgtccggagggcatgaccctcttcagcaccagtgcccaagtctgcgtgcccacgggctgccccaggtgtctggggccccacggagagccggtgaaggtgggccacaccgtcggcatggactgccaggagtgcacgtgtgaggcggccacgtggacgctgacctgccgacccaagctctgcccgctgccccctgcctgccccctgcccggcttcgtgcctgtgcctgcagccccacaggccggccagtgctgcccccagtacagctgcgcctgcaacaccagccgctgccccgcgcccgtgggctgtcctgagggcgcccgcgcgatcccgacctaccaggagggggcctgctgcccagtccaaaactgcagctggacagtgtgcagcatcaacgggaccctgtaccagcccggcgccgtggtctcctcgagcctgtgcgaaacctgcaggtgtgagctgccgggtggccccccatcggacgcgtttgtggtcagctgtgagacccagatctgcaacacacactgccctgtgggcttcgagtaccaggagcagagcgggcagtgctgtggcacctgtgtgcaggtcgcctgtgtcaccaacaccagcaagagccccgcccacctcttctaccctggcgagacctggtcagacgcagggaaccactgtgtgacccaccagtgtgagaagcaccaggatgggctcgtggtggtcaccacgaagaaggcgtgccccccgctcagctgttctctggacgaggcccgcatgagcaaggacggctgctgccgcttctgcccgctgcccccgcccccgtaccagaaccagtcgacctgtgctgtgtaccataggagcctgatcatccagcagcagggctgcagctcctcggagcccgtgcgcctggcttactgccgggggaactgtggggacagctcttccatgtactcgctcgagggcaacacggtggagcacaggtgccagtgctgccaggagctgcggacctcgctgaggaatgtgaccctgcactgcaccgacggctccagccgggccttcagctacaccgaggtggaagagtgcggctgcatgggccggcggtgccctgcgccgggcgacacccagcactcgaaggaggcggaacccgagcccagccaggaggcagagagtgggagctgggagagaggcgtcccagtgtcccccatgcactgaccagcactgccgccctcctgacctccaaggagaacctcccatatgtcctctgagctcggcttccaaggccagtggaacttgtgcccctgtccaggcggctgcagctttgaacacactgtccacgcccgctttcttgtggagggtgtgggctatgggtcacctgctgcctggaggaggggcccttacccaccccgcctgcagccacctctcaggaccagccccggggctggccgagctcctctggccatgcatccagcctgctgttctggggacgtgagcatcacctgagggtctcaggaatgacgcttggacatggtgatcagctgcctggtggctgcaggaggaagaacctcactcctacctcagccctcagcctgcgctcccctcctcagtacacggccaatctgttgcataaatacacttgagcattttgcaaaaaaaccccaaaaa

SEQ ID NO: 731602 - DNA, 1266 bp, Homo sapiens
tgtgaccccatatgggacttctcctaccaatgctctgtatccttccctgtctacttccatggtatccgcctccgtggcatccacctctgtggcatccagctctgtggcatccagctctgtggcttactccacccaaacctgcttctgcaacgtggctgaccggctctaccctgcaggatccaccatataccgccacagagacctcgctggccattgctattatgccctgtgtagccaggactgccaagtggtcagaggggttgacagtgactgtccgtccaccacgctgcctcctgccccagccacgtccccttcaatatccacctccgagcccgtcactgagctgggatgcccaaatgcggttccccccagaaagaaaggtgagacctgggccacacccaactgctccgaggccacctgtgagggcaacaacgtcatctccctgagcccgcgcacgtgcccgagggtggagaagcccacttgtgccaacggctacccggctgtgaaggtggctgaccaagatggctgctgccatcactaccagtgccagtgtgtgtgcagcggctggggtgacccccactacatcaccttcgacggcacctactacaccttcctggacaactgcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacaaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggcctctggaacgtgagcatccctgaccagccagcctgccaccggcctcacccgacgcccaccacggtcgggcccaccacagttgggtctaccacggtcgggcccaccacagttgggtctaccaccgtcgggcccaccacagttggctctaccaccgtcgggcccaccacaccgcctgctccgtgcctgccagctgctcagca

SEQ ID NO: 731603 - DNA, 5828 bp, Homo sapiens; identical to SEQ ID NO: 637780
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t

SEQ ID NO: 731604 - DNA, 5858 bp, Homo sapiens; identical to SEQ ID NO: 637781
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t

SEQ ID NO: 731605 - DNA, 6178 bp, Homo sapiens; identical to SEQ ID NO: 637778
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t

SEQ ID NO: 731606 - DNA, 6397 bp, Homo sapiens
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t
  misc_feature (5765)..(5765): n is a, c, g, or t
  misc_feature (5785)..(5785): n is a, c, g, or t
  misc_feature (5789)..(5789): n is a, c, g, or t
  misc_feature (5804)..(5804): n is a, c, g, or t
  misc_feature (5807)..(5807): n is a, c, g, or t
  misc_feature (5834)..(5834): n is a, c, g, or t
ctcagaggctgctgagggacagggcactcttccccgccgtccacacaatgagtgttggccggaggaagctggccctgctctgggccctggctctcgctctggcctgcacccggcatacagccatgcccaggatggctcctccgaatccagctacaagcaccaccctgccctctctcctatcgcccgggggcccancggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggangccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgangaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgngcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggangttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccngggncacaggggctggctgtcagaagagctgccacacactggacatgacctgttacagcccccantgtgtgcctggctgcgtgtgccccgacgggctggtggcggacggcgagggcggctgcatcactgcggaggactgcccctgcgtgcacaatnaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacncgctggtgcagaaccnctgtggcgggaaagacagcacccaggactcctttcgtgttgtcaccgagaacgtcccctgcggcaccacagggaccacctgctccaaggccatcaagattttcctgggggncttcgagctgaagctaagccatnggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggcccgctacgcccaggcctgccatgaagtaggcacctgtgtgtgtctgcggaccccaagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcgctgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagccgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctagcctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgctcctacaaccagcacaacctctggtnctggaactactcccagcccngttnccaccaccagcacanccnctgtttcaaagaccagcacaagccatntttctgtatccaagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctccacatctgtgacagctcctagcacccctagtgggagagccaccagcccaactcagagcacctcctcttggcagaaatccaggacaaccactttggtgacaagcagcataacctccactacacagaccagcacaacctctgcccctacaagtagcacaacccagcttcaatacccagcacatccgactggcccg

SEQ ID NO: 731607 - DNA, 2306 bp, Homo sapiens
ggtgatgacaaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggcctctggaacgtgagcatccctgaccagccagcctgccaccggcctcacccgacgcccaccacggtcgggcccaccacagttgggtctaccacggtcgggcccaccacagttgggtctaccaccgtcgggcccaccacaccgcctgctccgtgcctgccatcacccatctgccacctgattctgagcaaggtctttgagccgtgccacactgtgatccccccactgctgttctatgagggctgcgtctttgaccggtgccacatgacggacctggatgtggtgtgctccagcctggagctgtacgcggcactctgcgcgtcccacgacatctgcatcgattggagaggccggaccggccacatgtgcccattcacctgcccagccgacaaggtgtaccagccctgcggcccgagcaacccctcctactgctacgggaatgacagcgccagcctcggggctctccgggaggccggccccatcaccgaaggctgcttctgtccggagggcatgaccctcttcagcaccagtgcccaagtctgcgtgcccacgggctgccccaggtgtctggggccccacggagagccggtgaaggtgggccacaccgtcggcatggactgccaggagtgcacgtgtgaggcggccacgtggacgctgacctgccgacccaagctctgcccgctgccccctgcctgccccctgcccggcttcgtgcctgtgcctgcagccccacaggccggccagtgctgcccccagtacagctgcgcctgcaacaccagccgctgccccgcgcccgtgggctgtcctgagggcgcccgcgcgatcccgacctaccaggagggggcctgctgcccagtccaaaactgcagctggacagtgtgcagcatcaacgggaccctgtaccagcccggcgccgtggtctcctcgagcctgtgcgaaacctgcaggtgtgagctgccgggtggccccccatcggacgcgtttgtggtcagctgtgagacccagatctgcaacacacactgccctgtgggcttcgagtaccaggagcagagcgggcagtgctgtggcacctgtgtgcaggtcgcctgtgtcaccaacaccagcaagagccccgcccacctcttctaccctggcgagacctggtcagacgcagggaaccactgtgtgacccaccagtgtgagaagcaccaggatgggctcgtggtggtcaccacgaagaaggcgtgccccccgctcagctgttctctggacgaggcccgcatgagcaaggacggctgctgccgcttctgcccgctgcccccgcccccgtaccagaaccagtcgacctgtgctgtgtaccataggagcctgatcatccagcagcagggctgcagctcctcggagcccgtgcgcctggcttactgccgggggaactgtggggacagctcttccatgtactcgctcgagggcaacacggtggagcacaggtgccagtgctgccaggagctgcggacctcgctgaggaatgtgaccctgcactgcaccgacggctccagccgggccttcagctacaccgaggtggaagagtgcggctgcatgggccggcggtgccctgcgccgggcgacacccagcactcgaaggaggcggaacccgagcccagccaggaggcagagagtgggagctgggagagaggcgtcccagtgtcccccatgcactgaccagcactgccgccctcctgacctccaaggagaacctcccatatgtcctctgagctcggcttccaaggccagtggaacttgtgcccctctcaggaccagccccggggctggccgagctcctctggccatgcatccagcctgctgttctggggacgtgagcatcacctgagggtctcaggaatgacgcttggacatggtgatcagctgcctggtggctgcaggaggaagaacctcactcctacctcagccctcagcctgcgctcccctcctcagtacacggccaatctgttgcataaatacacttgagcattttgcaaaaaaaccccaaaaa

SEQ ID NO: 731608 - DNA, 3364 bp, Homo sapiens
agggagtgttcccgggggagatactccagtcgtagcaagagtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccatagaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcagtggaagcttacaaaacgactgggaagtttccaaaatcaatggtactcatgcccgactgtctaccaggcacacagactttgaggagagggagtatgtcgtcttgatccgcatcaatgatgggggtcggccacccttggaaggcattgtttctttaccagttacattctgcagttgtgtggaaggaagttgtttccggccagcaggtcaccagactgggatacccactgtgggcatggcagttggtatactgctgaccacccttctggtgattggtataattttagcagttgtgtttatccgcataaagaaggataaaggcaaagataatgttgaaagtgctcaagcatctgaagtcaaacctctgagaagctgaatttgaaaaggaatgtttgaatttatatagcaagtgctatttcagcaacaaccatctcatcctattacttttcatctaacgtgcattataattttttaaacagatattccctcttgtcctttaatatttgctaaatatttcttttttgaggtggagtcttgctctgtcgcccaggctggagtacagtggtgtgatcccagctcactgcaacctccgcctcctgggttcacatgattctcctgcctcagcttcctaagtagctgggtttacaggcacccaccaccatgcccagctaatttttgtatttttaatagagacggggtttcgccatttggccaggctggtcttgaactcctgacgtcaagtgatctgcctgccttggtctcccaatacaggcatgaaccactgcacccacctacttagatatttcatgtgctatagacattagagagatttttcatttttccatgacatttttcctctctgcaaatggcttagctacttgtgtttttcccttttggggcaagacagactcattaaatattctgtacattttttctttatcaaggagatatatcagtgttgtctcatagaactgcctggattccatttatgttttttctgattccatcctgtgtccccttcatccttgactcctttggtatttcactgaatttcaaacatttgtcagagaagaaaaaagtgaggactcaggaaaaataaataaataaaagaacagcctttt

SEQ ID NO: 731609 - DNA, 3682 bp, Homo sapiens
agggagtgttcccgggggagatactccagtcgtagcaagagtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccatagaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcagtggaagcttacaaaacgactgggaagtttccaaaatcaatggtactcatgcccgactgtctaccaggcacacagactttgaggagagggagtatgtcgtcttgatccgcatcaatgatgggggtcggccacccttggaaggcattgtttctttaccagttacattctgcagttgtgtggaaggaagttgtttccggccagcaggtcaccagactgggatacccactgtgggcatggcagttggtatactgctgaccacccttctggtgattggtataattttagcagttgtgtttatccgcataaagaaggataaaggcaaagataatgttgaaagtgctcaagcatctgaagtcaaacctctgagaagctgaatttgaaaaggaatgtttgaatttatatagcaagtgctatttcagcaacaaccatctcatcctattacttttcatctaacgtgcattataattttttaaacagatattccctcttgtcctttaatatttgctaaatatttcttttttgaggtggagtcttgctctgtcgcccaggctggagtacagtggtgtgatcccagctcactgcaacctccgcctcctgggttcacatgattctcctgcctcagcttcctaagtagctgggtttacaggcacccaccaccatgcccagctaatttttgtatttttaatagagacggggtttcgccatttggccaggctggtcttgaactcctgacgtcaagtgatctgcctgccttggtctcccaatacaggcatgaaccactgcacccacctacttagatatttcatgtgctatagacattagagagatttttcatttttccatgacatttttcctctctgcaaatggcttagctacttgtgtttttcccttttggggcaagacagactcattaaatattctgtacattttttctttatcaaggagatatatcagtgttgtctcatagaactgcctggattccatttatgttttttctgattccatcctgtgtccccttcatccttgactcctttggtatttcactgaatttcaaacatttgtcagagaagaaaaaagtgaggactcaggaaaaataaataaataaaagaacagccttttcccttagtattaacagaaatgtttctgtgtcattaaccatctttaatcaatgtgacatgttgctctttggctgaaattcttcaacttggaaatgacacagacccacagaaggtgttcaaacacaacctactctgcaaaccttggtaaaggaaccagtcagctggccagatttcctcactacctgccatgcatacatgctgcgcatgttttcttcattcgtatgttagtaaagttttggttattatatatttaacatgtggaagaaaacaagacatgaaaagagtggtgacaaatcaagaataaacactggttgtagtc

SEQ ID NO: 731610 - DNA, 3821 bp, Homo sapiens; identical to SEQ ID NO: 322471

SEQ ID NO: 731611 - DNA, 471 bp, Homo sapiens
  misc_feature (387)..(387): n is a, c, g, or t
  misc_feature (402)..(402): n is a, c, g, or t
  misc_feature (408)..(408): n is a, c, g, or t
ggcccgaccacctacctccccgccgctccagagggggctcgcagagctgaggacgcgcgcagcgctgctcaaggtctctctctctcagcaccctcgccggccggcgtctgacgcgggtgccagggtctccgggcacctttcagtgtccattccctcagccagccaggactccgcaacccagcagttgccgctgcggccacagcccgaggggacctgcggacaggacgccggcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtgaactatgancactctactctgggntttcgngactctgagggtcatcactgcagctgtcactggagaaacttcggaccatgacaactctgtgag

SEQ ID NO: 731612 - DNA, 1467 bp, Homo sapiens
agccagagacagctgggccactggcagtgagggagagtgaggatggcagagaccagtgccctgcccactggcttcggggagctcgaggtgctggctgtggggatggtgctactggtggaagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtaaacaccactctgccagcaaggacgctgctgctcggctggggcccctatgccatcctgtatctatacgcagtcatcgcagacgtgacttccatctcccccaaactgcagatggtgcccgccctcattgccaaaatggtgcccacgatcaatgccatcaactatgccctgggcaatgagatggtctgcaggggaatctggcagtgcctctcaccgcagaagagggagaaggaccgaaccaagtgagcctgccaccctggagtgagccccaggccaggaggctgttccaggagtcctgcccagcagcctcggtggccaagcccagacactcacccaccttccccagtggccccgtggatcctggtcctaggctggacacaggattcagaaagacaccaggctgcacagaaagagccagatggacctgagtgtcggtcacagccccctacactcaaggctgagaggcctcaggaaagtcattcctttttaaaaataataataaatgtaagggggtacagtgcagttttgttacatggatagattgcctagtggtgaagtctgggcttttagtgtaaccatcaccctaataatatacgttgtacccattaagttatttctcatccctcaccccctcccaccttgtcacccttctgagtctccaatgtctattattccacactccatgtccacgtgtacacattatttagctcccacttacaagtgagaacatgtggtatttgactttctgtttttgagttatttcacttaaaataatgacctccagtttcatccatg

SEQ ID NO: 731613 - DNA, 884 bp, Homo sapiens
agccagagacagctgggccactggcagtgagggagagtgaggatggcagagaccagtgccctgcccactggcttcggggagctcgaggtgctggctgtggggatggtgctactggtggaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgccaaaatgctgccatcggtctcatcattttgagtggcgataggttagccctcttgtccacttggcctcagagcacttctcccactccttacatcccagcccctgcccctaatgctcccttggaccatcttatacacacacacacacacacacacacacacacacacacacacacacaccaccttctcagatagcaacaggcttctctgcctcaatatagaacagttaatccctgtgccagaggccttagatcaaagccctttctatactgagagcatggcagagcagtgtgaaggcaggcaaaggggaatgaggaggtctgaattcatctactccatccctgggtggttgtaggcatgtcaccttggccatctgtttctaaagctgaaagtctgaggcagcacaatggtccaggtagatattaattattgtgcccacagagaattgtttgaacctggaaggcagaggttgcagtgagctgagatggcaccactgcactccagcctgggcaacagaatgagactccgcctcaat

SEQ ID NO: 731614 - DNA, 1353 bp, Homo sapiens
agccagagacagctgggccactggcagtgagggagagtgaggatggcagagaccagtgccctgcccactggcttcggggagctcgaggtgctggctgtggggatggtgctactggtggaagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtgcccgccctcattgccaaaatggtgcccacgatcaatgccatcaactatgccctgggcaatgagatggtctgcaggggaatctggcagtgcctctcaccgcagaagagggagaaggaccgaaccaagtgagcctgccaccctggagtgagccccaggccaggaggctgttccaggagtcctgcccagcagcctcggtggccaagcccagacactcacccaccttccccagtggccccgtggatcctggtcctaggctggacacaggattcagaaagacaccaggctgcacagaaagagccagatggacctgagtgtcggtcacagccccctacactcaaggctgagaggcctcaggaaagtcattcctttttaaaaataataataaatgtaagggggtacagtgcagttttgttacatggatagattgcctagtggtgaagtctgggcttttagtgtaaccatcaccctaataatatacgttgtacccattaagttatttctcatccctcaccccctcccaccttgtcacccttctgagtctccaatgtctattattccacactccatgtccacgtgtacacattatttagctcccacttacaagtgagaacatgtggtatttgactttctgtttttgagttatttcacttaaaataatgacctccagtttcatccatg

SEQ ID NO: 731615 - DNA, 870 bp, Homo sapiens
agccagagacagctgggccactggcagtgagggagagtgaggatggcagagaccagtgccctgcccactggcttcggggagctcgaggtgctggctgtggggatggtgctactggtggaagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtaaacaccactctgccagcaaggacgctgctgctcggctggggcccctatgccatcctgtatctatacgcagtcatcgcagacgtgacttccatctcccccaaactgcagatggtacagatacttctagtacctaaaactagacccctctccatctttgttctctgtctcatctcatctcactttctggatttatga

SEQ ID NO: 731616 - DNA, 1477 bp, Homo sapiens
cgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaattattctgg

SEQ ID NO: 731617 - DNA, 533 bp, Homo sapiens
ccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcggtc

SEQ ID NO: 731618 - DNA, 1619 bp, Homo sapiens
cgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatggtgcagccgggagcccagatgcctgggtctgagggaggaggggacaggactcctgggtctgagggaggagggccaaggaaccaggtggggtccagcccacaacagtgtttttgcctggcccgtatcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaattattctgg

SEQ ID NO: 731619 - DNA, 2700 bp, Homo sapiens
ccggagagctgtgtcaccatgtgggtcccggttgtcttcctcaccctgtccgtgacgtggattggtgagaggggccatggttggggggatgcaggagagggagccagccctgactgtcaagctgaggctctttcccccccaacccagcaccccagcccagacagggagctgggctcttttctgtctctcccagccccactccaagcccatacccccagcccctccatattgcaacagtcctcactcccacaccaggtccccgctccctcccacttaccccagaactttctccccattgcccagccaactccctgctcccagctgctttactaaaggggaagttcctgggcatctccgtgtttctctttgtggggctcaaaacctccaaggacctctctcaatgccattggttccttggaccgtatcactggtccacctcctgagcccctcaatcctatcacagtctactgacttttcccattcagctgtgagtgtccaaccctatcccagagaccttgatgcttggcctcccaatcttgccctaggatacccagatgccaaccagacacctccttcttcctagccaggctatctggcctgagacaacaaatgggtccctcagtctggcaatgggactctgagaactcctcattccctgactcttagccccagactcttcattcagtggcccacattttccttaggaaaaacatgagcatccccagccacaactgccagctctctgattccccaaatctgcatccttttcaaaacctaaaaacaaaaagaaaaacaaataaaacaaaaccaactcagaccagaactgttttctcaacctgggacttcctaaactttccaaaaccttcctcttccagcaactgaacctcgccataaggcacttatccctggttcctagcaccccttatcccctcagaatccacaaacttttgtacaccaaagttttccctttctcaccaagtccaagaccccaaatcaccacaaaggacccaatccccagactcaagatatggtctgggcgctgtcttgtgtctcctaccctgatccctgggttcaactctgctcccagagcatgaagcctctccaccagcaccagccaccaacctgcaaacctagggaagattgacagaattcccagcctttcccagctccccctgcccatgtcccaggactcccagccttggttctctgcccccgtgtcttttcaaacccacatcctaaatccatctcctatccgagtcccccagttcctcctgtcaaccctgattcccctgatctagcaccccctctgcaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaattattctgg

SEQ ID NO: 731620 - DNA, 923 bp, Homo sapiens
gtctctctcccttttctctcccacactctatcatcccccggattcctctctacttggttctcattcttcctttgacttcctgcttccctttctcattcatctgtttctcactttctgcctggttttgttcttctctctctctttctctggcccatgtctgtttctctatgtttctgtcttttctttctcatcctgtgtattttcggctcaccttgtttgtcactgttctcccctctgccctttcattctctctgtccttttaccctcttcctttttcccttggtttctctcagtttctgtatctgcccttcaccctctcacactgctgtttcccaactcgttgtctgtatttttggcctgaactgtgtcttccccaaccctgtgtttttctcactgtttctttttctcttttggagcctcctccttgctcctctgtcccttctctctttccttatcatcctcgctcctcattcctgcgtctgcttcctccccagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatggtgcagccgggagcccagatgcctgggtctgagggaggaggggacaggactcctgggtctgagggaggagggccaaggaaccaggtggggtccagcccacaacagtgtttttgcctggcccgta

SEQ ID NO: 731621 - DNA, 1722 bp, Homo sapiens
gtctctctcccttttctctcccacactctatcatcccccggattcctctctacttggttctcattcttcctttgacttcctgcttccctttctcattcatctgtttctcactttctgcctggttttgttcttctctctctctttctctggcccatgtctgtttctctatgtttctgtcttttctttctcatcctgtgtattttcggctcaccttgtttgtcactgttctcccctctgccctttcattctctctgtccttttaccctcttcctttttcccttggtttctctcagtttctgtatctgcccttcaccctctcacactgctgtttcccaactcgttgtctgtatttttggcctgaactgtgtcttccccaaccctgtgtttttctcactgtttctttttctcttttggagcctcctccttgctcctctgtcccttctctctttccttatcatcctcgctcctcattcctgcgtctgcttcctccccagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaattattctgg

SEQ ID NO: 731622 - DNA, 646 bp, Homo sapiens
ccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgataagcaaggactgtgggaggtgggctttgtagtaacaagagggcagggtgaactctgattcccatgggggaatgtgatggtcctgttacaaatttttcaagctggcagggaataaaacccattacggtgaggacctgtggagggcggctgccccaactgataaaggaaatagccaggtgggggcctttcccattgtaggggggacatatctggcaatagaagcctttgagaccctttagggtacaagtactgaggcagcaaataaaatgaaatcttatttttcaactttatactgcatggg

SEQ ID NO: 731623 - DNA, 1350 bp, Homo sapiens
cgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaattattctgg

SEQ ID NO: 731624 - DNA, 466 bp, Homo sapiens
gtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaattattctgg

SEQ ID NO: 731625 - DNA, 1383 bp, Homo sapiens
cgagccccaagcttaccacctgcacccggagagctgtgtcaccatgtgggtcccggttgtcttcctcaccctgtccgtgacgtggattgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaattattctgg

SEQ ID NO: 731626 - DNA, 1355 bp, Homo sapiens
cgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaatcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaattattctgg

SEQ ID NO: 731627 - DNA, 1919 bp, Homo sapiens
  misc_feature (914)..(914): n is a, c, g, or t
cgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttcccnaccggccaggactggagcccctacccctctgttggaatccctgcccaccttcttctggaagtcggctctggagacatttctctcttcttccaaagctgggaactgctatctgttatctgcctgtccaggtctgaaagataggattgcccaggcagaaactgggactgacctatctcactctctccctgcttttacccttagggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaattattctgg

SEQ ID NO: 731628 - DNA, 1595 bp, Homo sapiens
gtctctctcccttttctctcccacactctatcatcccccggattcctctctacttggttctcattcttcctttgacttcctgcttccctttctcattcatctgtttctcactttctgcctggttttgttcttctctctctctttctctggcccatgtctgtttctctatgtttctgtcttttctttctcatcctgtgtattttcggctcaccttgtttgtcactgttctcccctctgccctttcattctctctgtccttttaccctcttcctttttcccttggtttctctcagtttctgtatctgcccttcaccctctcacactgctgtttcccaactcgttgtctgtatttttggcctgaactgtgtcttccccaaccctgtgtttttctcactgtttctttttctcttttggagcctcctccttgctcctctgtcccttctctctttccttatcatcctcgctcctcattcctgcgtctgcttcctccccagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaattattctgg

SEQ ID NO: 731629 - DNA, 1268 bp, Homo sapiens
tgactctctgaggctcattttgcagttgttgaaattgtccccgcagttttcaatcatgtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatga

SEQ ID NO: 731630 - DNA, 3200 bp, Homo sapiens
  misc_feature (2034)..(2034): n is a, c, g, or t
  misc_feature (2146)..(2146): n is a, c, g, or t
  misc_feature (2577)..(2577): n is a, c, g, or t
  misc_feature (2618)..(2618): n is a, c, g, or t
  misc_feature (2965)..(2965): n is a, c, g, or t
agcggagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagttcaccatttcaggtcactgctggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatntatgtccaatttgattgggatagtagttaggataactaaaattctgggcctaattttttaaagaatccaagacaaactaaactttactgggtatataaccttctcaatgagntaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcnaaggccaagccgtggaatggtagcaatgggatataataccnttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatntctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 731631 - DNA, 3776 bp, Homo sapiens
  misc_feature (2610)..(2610): n is a, c, g, or t
  misc_feature (2722)..(2722): n is a, c, g, or t
  misc_feature (3153)..(3153): n is a, c, g, or t
  misc_feature (3194)..(3194): n is a, c, g, or t
  misc_feature (3541)..(3541): n is a, c, g, or t
agcggagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatntatgtccaatttgattgggatagtagttaggataactaaaattctgggcctaattttttaaagaatccaagacaaactaaactttactgggtatataaccttctcaatgagntaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcnaaggccaagccgtggaatggtagcaatgggatataataccnttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatntctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 731632 - DNA, 3560 bp, Homo sapiens
  misc_feature (2394)..(2394): n is a, c, g, or t
  misc_feature (2506)..(2506): n is a, c, g, or t
  misc_feature (2937)..(2937): n is a, c, g, or t
  misc_feature (2978)..(2978): n is a, c, g, or t
  misc_feature (3325)..(3325): n is a, c, g, or t
agcggagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatntatgtccaatttgattgggatagtagttaggataactaaaattctgggcctaattttttaaagaatccaagacaaactaaactttactgggtatataaccttctcaatgagntaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcnaaggccaagccgtggaatggtagcaatgggatataataccnttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatntctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 731633 - DNA, 1988 bp, Homo sapiens; identical to SEQ ID NO: 47708

SEQ ID NO: 731634 - DNA, 823 bp, Homo sapiens; identical to SEQ ID NO: 89374

SEQ ID NO: 731635 - DNA, 2995 bp, Homo sapiens; identical to SEQ ID NO: 89382

SEQ ID NO: 731636 - DNA, 684 bp, Homo sapiens
gaccgactgtgtggaagcaccaggcatcagagatagagtcttccctggcattgcaggagagaatctgaagggatgatggatgcatcaaaaggtgagtgggtgaaatctccatggagccccacatgccccttcagccagctggccctaaactgctctcttgcctctgccgggtgcctggggccattgccctctcaccctgacttgtggccctggtgctgcttgctttctgtctcatccctttttagaaaacccacaaacttttcatttaggcataatttcagatttacaaaaagattgcaagaataaaaagaagaatttccatatatcctttatccagattccctaaattattactgcatttgctttatccttctcgatcagtggacagatagatgatatagacagatagatagacaaatatatattttttgaactcttgagagtaagttgcagatattacattattaaatatttggtgtgtatttcctaaagacaaggacattctcttacgtaaccaatacaattatgaagaccaggacatgaacaccatttcaatactgttatccaacccacagattttatgcagattcatcaactgtcccaataatgtcatttatagcagaagaaatcctggttaggcttgattccgtgttgtgcctcttcggtcccctttgtctggaatag

SEQ ID NO: 731637 - DNA, 227 bp, Homo sapiens; identical to SEQ ID NO: 89377

SEQ ID NO: 731638 - DNA, 2486 bp, Homo sapiens
tgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctacttcaagaaaactctgtggtccctgagtccttttttctttatgccaataagcttcttaaatgtgctggcggtttatgcagtcacttggggagccatggaatcctttgatctccccaggcaaggtgctctgaggagttggcttctttattgtctgttcagtacatccaacccctctctcaaaggctgtcaccccaactggatacacaccctggcaaaggcacgtagcttgaatgagggttattttgtgtctaattcacaggagagtcatgggtgggatacctgtcatcctctgcctttccagctgtccaagtgaaaaaaacctcaatcctggtcacccttgcccaagttgcccacatccctggcatacagtaggtgttcaataaatgtttattgaagga

SEQ ID NO: 731639 - DNA, 555 bp, Homo sapiens
agctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggccgaatcctagcatcgccaaacacaccctggtggtgctcgacccgaggacgccctcagaccactacaactggcaggcaacccttcaaaatgagtctggcaaagaggtgagcacccactgggctggcgggtgggctggctggcttctggcggaatgctcctaatgtgagcagcccctatccccttcctcacctgtcagctggtaacatggtttaaagccatccacagcacagcatgatagaggggccatggctccaaatgtctgtttccccactcagcctcctccaagcacacagtatcgctgtggccaaacctcctacatgtcacccttcccctttccatttcaaagggaacaatgttcactggaggacatgagcggag

SEQ ID NO: 731640 - DNA, 795 bp, Homo sapiens
gaccgactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactacgaaggtggcacagccccatacaagtggacaggcagtgccccgatcctgcagcagtactacaacacgaagcaggctgtgtgctttggccagtgctgggtgtttgctgggatcctgactacag

SEQ ID NO: 731641 - DNA, 634 bp, Homo sapiens
gaccgactgtgtggaagcaccaggcatcagagatagagtcttccctggcattgcaggagagaatctgaagggatgatggatgcatcaaaagagttgaggtctcactttgttgcccaggctgcgtgttgtggctattcacagctgcaatcatagctcactgcagcctcaaactcctgggctcaagtgattctcccacctcagtctcccgagtaaccgggattacagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggccgaatcctagcatcgccaaacacaccctggtggtgctcgacccgaggacgccctcagaccactacaactggcaggcaacccttcaaaatgagtctggcaaagaggtcacagtggctgtcaccagttcccccaatgccatcctgggcaagtaccaactaaacgtgaaaactggaaaccacatccttaagtctgaagaaaacatcctataccttctcttcaacccatggtgtaaag

SEQ ID NO: 731642 - DNA, 2089 bp, Homo sapiens
tgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagaaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctacttcaagaaaactctgtggtccctgagtccttttttctttatgccaataagcttcttaaatgtgctggcggtttatgcagtcacttggggagccatggaatcctttgatctccccaggcaaggtgctctgaggagttggcttctttattgtctgttcagtacatccaacccctctctcaaaggctgtcaccccaactggatacacaccctggcaaaggcacgtagcttgaatgagggttattttgtgtctaattcacaggagagtcatgggtgggatacctgtcatcctctgcctttccagctgtccaagtgaaaaaaacctcaatcctggtcacccttgcccaagttgcccacatccctggcatacagtaggtgttcaataaatgtttattgaagga

SEQ ID NO: 731643 - DNA, 2754 bp, Homo sapiens; identical to SEQ ID NO: 85386

SEQ ID NO: 731644 - DNA, 2856 bp, Homo sapiens; identical to SEQ ID NO: 85388

SEQ ID NO: 731645 - DNA, 2862 bp, Homo sapiens; identical to SEQ ID NO: 85387

SEQ ID NO: 731646 - DNA, 482 bp, Homo sapiens; identical to SEQ ID NO: 728790

SEQ ID NO: 731647 - DNA, 585 bp, Homo sapiens
  misc_feature (3)..(4): n is a, c, g, or t
  misc_feature (6)..(6): n is a, c, g, or t
  misc_feature (15)..(15): n is a, c, g, or t
  misc_feature (129)..(129): n is a, c, g, or t
tcnntntttgccagnaatgttggaagtggacatttcattggcctggcagggtcaggtgctgctacgggcatttctgtatcagcttatgaacttaatggcttgttttctgtgctgatgttggcctggatnttcctacccatctacattgctgtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctg

SEQ ID NO: 731648 - DNA, 438 bp, Homo sapiens
  misc_feature (412)..(412): n is a, c, g, or t
aaaaatgagtctcggagacctgtgttaactcttgtggtcgtctttgaacccagatctgcctgctgtcatggtcttgttttaatcactgctgaggaggggagggggcacaactggatgaagtgatgacatgatgtttaggagacacagaactaggaagcatcgcaaaggccttctttttccactctcctcttccttccagaatccattccccatgttaaaaaaggaaatttgaaggccagcacaggtgaaccactcagcgagtaagagactacaccagaggtggagttcaggccaggctgcctcagggcgcagagggaaatccaaatgggtaccttgttgtgagctgggggccaagtcctgactgtgttttcttgagcagggcttgttttctgtgctgatgttggcctggatnttcctacccatctacattgctgtcag

SEQ ID NO: 731649 - DNA, 929 bp, Homo sapiens; identical to SEQ ID NO: 387322

SEQ ID NO: 731650 - DNA, 3530 bp, Homo sapiens
  misc_feature (825)..(825): n is a, c, g, or t
  misc_feature (841)..(847): n is a, c, g, or t
  misc_feature (859)..(859): n is a, c, g, or t
  misc_feature (870)..(870): n is a, c, g, or t
  misc_feature (873)..(873): n is a, c, g, or t
  misc_feature (875)..(875): n is a, c, g, or t
  misc_feature (895)..(895): n is a, c, g, or t
  misc_feature (901)..(901): n is a, c, g, or t
  misc_feature (904)..(904): n is a, c, g, or t
ctttgaagaacatcctgaagattatatcggagacaatatatcaagaatctatttattgaatcatctagaacaaaagccaggagctccctaatggaagcacattagtgtttattttgatgaagaaatatatagattttttaaaacaaccacaaagtagatagctcagtaaaaaatcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagtnatcatcattggcctannnnnnntagtaacgacantcacaggtatntcnangtctgctatttgccacgaanggagtngtnagaggaggtggggcctactatcttatttccagaagtttagggcccgagttcggtgggtcaataggcctgatctttgcttttgctaatgcagtggctgttgctatgtatgtggtgggattcgctgaaactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaacaggagagactagcattggaagcgactatcaaagataatgagtgtgaagaggaaagtggaggcatccgaggcttgtttaaaaaagctggcaagttgaacattactaagacaacgcctaaaaaagatggcagcattaacacaagccagtcgatgcatgtgggagagttcaaccagaaactggtggaagccagcactcaatttaaaaagaaacaagaaaaaggcacaattgatgtttggtggttgtttgatgatggagggttaacacttcttatcccctatatcttaactctcagaaaaaaatggaaagactgtaaattaagaatctatgtgggagggaagatcaaccgcattgaagaagaaaaaattgcaatggcttcccttctgagcaaatttaggataaaatttgcagacatccatatcatcggtgacatcaacattaggccaaacaaagagagctggaaagtctttgaagagatgattgaaccatatcgtctccatgaaagctgcaaagatttaacaactgctgagaaattaaaaagagaaactccgtggaaaattacagatgcagaactggaagcagtcaaggaaaagagttaccgccaagttcgactgaatgaactcttacaggagcactccagagctgctaatctcattgtcctgagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcata

SEQ ID NO: 731651 - DNA, 1618 bp, Homo sapiens
aatggcttcccttctgagcaaatttaggataaaatttgcagacatccatatcatcggtgacatcaacattaggccaaacaaagagagctggaaagtctttgaagagatgattgaaccatatcgtctccatgaaagctgcaaagatttaacaactgctgagaaattaaaaagagaaactccgtggaaaattacagatgcagaactggaagcagtcaaggaaaagagttaccgccaagttcgactgaatgaactcttacaggagcactccagagctgctaatctcattgtcctgagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcataattaagaaacatgttccagtactttatgttgtaaatctgatctatggatatgcaaacctctggagatgatcctaccagattctacatacattgcataatttttatcagttaatgcgagcttttttttctcttctcagcttaaggggttgtcaaagccaatgttatccctagaaaaacatttttgtcactgctgttgataaacaagaaaatcaaggaaactcatgttggcttatgctcatggaaaccaccaatgtgattgtaaacttctccagacaaacttaaccttttgtttcttaattttttgttctgagtgtttgcttctcagccctggtataggtctcagccccacagcaggatctcaataaatgcttattgacaggctggcatagtaaccacaggtggttatcaaaggaaaagaccaataggctggggaacataattatgcttggcccctcagaggcttatactccaaagcagatttaaaaatcagtaactcaaaactttaagaagtagttgagtctacaaaatattcaaagcagttacctaaataaggttatttaatgtaacagattatatacttaaagtgatctgagcaatcattgataacatatggcttaaatttgctgctgcctgaaaagtatattaactagattagaagacaccatatactccaataaaatgaaatatattctattctcaatatataaactttaattgtactccctatcaaatattttgaaatttccatcacggcattactttgcatatttttttctaattaaatggttagtacagatgaaatctttatagatgactacttgaaaactaagtgctacaaattttcaaaccattattaagaaatatatcctgaatcatatatttagttactttctatagtgattgtatggatttaaaagaataattaaaatgtgaagttgaaaaacttgtaaaatttggaatatacagatactgatttttttcatttttgttagtatacctataatacataatcacattgacaaaccaatgaaaatattgtttttctgatgaatggcttgatttttctccttgacatgttttgactgttcattctaactgaaaacatatatgggaaaatatgaacctgaaataaaagcactcaaattcaa

SEQ ID NO: 731652 - DNA, 928 bp, Homo sapiens
ggtcttggtgtgattatcatcggcttagccgtgacagtgactggtatcactggtttatccacctctgctattgccacaaatggatgtgtcagaggaggtggggcctactatcttatttccagaagtttagggcccgagttcggtgggtcaataggcctgatctttgcttttgctaatgcagtggctgttgctatgtatgtggtgggattcgctgaaactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggtacgttgtttgctctgctttgcagtcctgggagtggtggtacacttggtgggtagcacaaggagctagagaggttagatgtgaccatattaccctacagattcaaactgtaggtttctgcaagatttcctgatgatttaaaagttctctcttttaatgccaaatttggatttatattccagataattcttccaaaagtcttattcagtgatatcagaagaacagggtagtgtgatagtgtgtcatatttccccaaaataaatgtagttcagtgaaaaaaataccagaaccaccctttctcttttaaacccaaatgaataggaatattttcctgtaaaag

SEQ ID NO: 731653 - DNA, 519 bp, Homo sapiens; identical to SEQ ID NO: 387319

SEQ ID NO: 731654 - DNA, 654 bp, Homo sapiens; identical to SEQ ID NO: 387320

SEQ ID NO: 731655 - DNA, 721 bp, Homo sapiens; identical to SEQ ID NO: 387321

SEQ ID NO: 731656 - DNA, 870 bp, Homo sapiens; identical to SEQ ID NO: 87955

SEQ ID NO: 731657 - DNA, 1101 bp, Homo sapiens; identical to SEQ ID NO: 87956

SEQ ID NO: 731658 - DNA, 2664 bp, Homo sapiens; identical to SEQ ID NO: 88007

SEQ ID NO: 731659 - DNA, 388 bp, Homo sapiens; identical to SEQ ID NO: 89609

SEQ ID NO: 731660 - DNA, 2732 bp, Homo sapiens
ctggctgtgctgttcatctcctagatgaatgggatggtctacattcatccatttggatttggccaaagacaccaacacccctttctccctctacataagctgcactgcatggttgctgctggatgtgttgtgttcctggcttccctctggatgctgacagaaacaaggctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcatcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaggggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtgaggacagaacatgcttgtgcttctgcgcttctgagggctgttctcccccgggaaccatctgtccccaccttccctttcccagagccctcttcagggaagccacaggacttagacccagctcaatcccacaattgggaaggggtcatggagtgagtgtgcagagagtgagtgaggacataaggaaggacatgtcccactccatcccccttcctgctcccccatttcctaactcccccagtgtgaattctcagggtcacttctgcctcctcccgtttcccctccacatccaaacagcaccctggtcctctctatcccccctctcctggggtccctcacatgccccttcccttctgttgtgggctgcacaccaaagcctcctcccctccccacttcctaggcactaggatctctctgtggcttcccctgctgggtggtgtcacctctttctctgctttcagagaaacccttcccgcctttcctcagagtgcttcccaaactgaggtcccatggcacactgtcctgggaggcgttcagagggttccatgatggactaggtttggaaccactgggttaaataaacttagagagggctgtttaga

SEQ ID NO: 731661 - DNA, 436 bp, Homo sapiens
ctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccagacgaggtcttgctatgttgaccaggctggtcttgaactcctggccttaaatgatcctactgccttggcttcccaaagtgctgggattacaggatattcaaaagtacacctgccgagtcccagccctgaggagtgttttcgtgcttcattgttaagtatcttggaggctctcagctggaaataaatgctcttcatttattaaagaagcatccttatatttttaagagtctttgaaaa

SEQ ID NO: 731662 - DNA, 307 bp, Homo sapiens
ctgcactgcatggttgctgctggatgtgttgtgttcctggcttccctctggatgctgacagaaacaagggtgagagaaaaggacagtaggagaggagggaaggcgggactgaagaaaggaggggaagggggtagcacagggcaaagtggaaaagcaggtagcgtcctttttttcttcactagggcttggtgaagaccccttcgaggacagctccaggcccatccctgtggtggccacccatggagacagtagtgctgctcagaggcatttagtttttgtttcttttctgtttttgaggtagagtctc

SEQ ID NO: 731663 - DNA, 854 bp, Homo sapiens
ggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagagggatcccaggccatggagcaaggagggcccgaatcagtacctccctcagatcacctggacagtgtgagacaaaaagccgcagggaccatccctggagggggattcagcaggctcgatcggggtccaggtgctggtatttttcattagcctccaggggattctgatgtagccagcagcgtccttggacaacagtttgagatctgctgcttttcaaactggattccttggagcgctggaaatctcagcgatgtcacagggcaggagagggaggttgtggagggaaaattcagacttcccgcccagcccaccatttcaccaggcagctctaaatttatgtgttttataagccaaggttcacacaaaaaagaaaattcgctgggggaaaaaaacagtttctatggcttaaaaaaaagtctgaagaccaccagtctatttcaatactctattttgttgatgaagaagctggtgaccaaagatacccaaagactaagtcagggggatgcaggggtacaggggtgcctctcactttcccaaagtgagatccacataccacagcaaaatgatttgagccagcctgtggatgaacacatttaaaattttatttataaatacatttactgttacatttgacttctctttattaaatacatttgtgatttatttttgcaat

SEQ ID NO: 731664 - DNA, 599 bp, Homo sapiens; identical to SEQ ID NO: 89612

SEQ ID NO: 731665 - DNA, 2438 bp, Homo sapiens; identical to SEQ ID NO: 457556

SEQ ID NO: 731666 - DNA, 428 bp, Homo sapiens
attatcgggaccattccactgatgcctaatccggggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcagatcctcaaacggcagcgggtgaggtggatggggttaatctggaggagatccgagaatttgccaaagcttttaaaatccggcgcctgtcccttggcctgacccagactcaggtgggacaggctctcagtgctacagagggccccgcgtacagccagtcggccatctgcagacacaccatcctgagaagccactttttcctaccacaggagcccaagagaaca

SEQ ID NO: 731667 - DNA, 4091 bp, Homo sapiens; identical to SEQ ID NO: 320591

SEQ ID NO: 731668 - DNA, 4145 bp, Homo sapiens; identical to SEQ ID NO: 320577

SEQ ID NO: 731669 - DNA, 563 bp, Homo sapiens
atcagtcgtggtgactgccctggttgcactgtaagtatggggggacgtctccacgaaaaaaaactaactttctgccttgtgctctgcaggtccctccttctcccaccttccccaagtagctgctcctgacccccccacacaccttggcaaacgacaccagtggccgatagcaactggtgttttaaaaatactaatttggagccccatttgagacctacaacgggagagtctgcatcagattcggcctcagattctacagcatctgactacattcccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctac

SEQ ID NO: 731670 - DNA, 558 bp, Homo sapiens
gctggtaaatttagagaaggcatcatactgggatcttttttcacatccagcccatgcggactgagcagccaaagcttgacagaggtccctccttctcccaccttccccaagtagctgctcctgacccccccacacaccttggcaaacgacaccagtggccgatagcaactggtgttttaaaaatactaatttggagccccatttgagacctacaacgggagagtctgcatcagattcggcctcagattctacagcatctgactacattcccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctac

SEQ ID NO: 731671 - DNA, 369 bp, Homo sapiens
gctggtaaatttagagaaggcatcatactgggatcttttttcacatccagcccatgcggactgagcagccaaagcttgacagagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctac

SEQ ID NO: 731672 - DNA, 1977 bp, Homo sapiens
gatagcagtgtaggtggttagcggcacctcggataaggtcctcctaggtcaaagggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggagttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaattgcgcaggttagctgaaatgaacaatatgtccatcttaaagtgtgctttttcgactaattaaatctttgaaaag

SEQ ID NO: 731673 - DNA, 2748 bp, Homo sapiens
  misc_feature (1914)..(1914): n is a, c, g, or t
  misc_feature (2032)..(2033): n is a, c, g, or t
  misc_feature (2703)..(2703): n is a, c, g, or t
gatagcagtgtaggtggttagcggcacctcggataaggtcctcctaggtcaaagggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggagttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgatctttgtgacctgtatcttgtgccaacctcctatctcatcctgtgactaagaatncttaacctcctgggagggcagctcaggaggtgtcagcctcattttacccagccctattcaagatggagtcactctggttccaatgcttctgacagcagtagagataacacagtattcnngcaagagaacagagctcctgatcacctgtgtgcgtcctttgagtggatggcagctgcatctctgcattacagctagttagaatgatgagtccttgctatgcctcaagcactgtttcgagtgtttgatgtctattatctcacttcatcctcaccaggaccccatccgagccttaatttcagttgacagtaactattggatccccaggaatatgtttgcatatttggggagaaaatactattggaggggaacagaaatgctactaagggtctcactgtgtcacccaggctggagtccatcaaagctcactgcagccttaaccttctgtgctcaagggatcctcccacttaagcctcctgagtagctggaactacaggcatatgccaccgagcctggctaatctttgatttttttgtacagattgtgtctccttatgttgctcaggctggactcaaacttctggtctcaagcgatctttccatcttagcttcccaaattgttggaattatggacatgagccagtgtgcttggcctgatttttttttttttttaatgagaaaaacgttccttaagaaaagtttcattgtaagacgaggacttgctatgttgccagtttggtcttgaactcggtctcaagtgattctcctgccttgggttcccaaagcgttgggncggcagatgtcagccaccgcgcctgccttattcttataaactcaa

SEQ ID NO: 731674 - DNA, 1389 bp, Homo sapiens
ctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgt

SEQ ID NO: 731675 - DNA, 1575 bp, Homo sapiens
ggcacgaggctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgt

SEQ ID NO: 731676 - DNA, 1309 bp, Homo sapiens
ctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctgaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgt

SEQ ID NO: 731677 - DNA, 2292 bp, Homo sapiens
gagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaacgcagccccttgccaccagcggtgcctcgggctgcccggcgcgccgcctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaagagtctcagtcgcccaggctggagtgcagcagcacagtctcacctcattgcaacctccgcctcccgggttcgcgggttctccgcctcagcttcctagtagctgggattgcaggcactcaccaccatgcccggctaattttttgaatttttagtggagacgggatttcaccatgttggccatgctggtcttgaacccccgacctcggatgattcgcccgcctcggcctcccaaagtgctggaattacaggcgaaccttcactcagaagaaatgctgtggcccttccctttaccaacagaaaatggaacacaagagaccacatagctgaacaaattatagcctccttacaagtgagaaaccttcgaggctacatagttttcagccaaaggaaaataaccaacagcttctccacagtgtagactgaaacaagggaaacatgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttagactgtaaaaagctaaaaggcacgactttttccagagcctcatgagtggatgggggtaaggggtgcaacttattaattcttgaacatacttggttcaggagagtttgtaagtatgtgtggtcttgtttccttgtttgtttgtttgttttgttctgttttgtttgaggattgttatttggcgtgctgttttctacctctggtcttatctgtgatacataatttcaaataaacattatcatacaaaaacagaaa

SEQ ID NO: 731678 - DNA, 1035 bp, Homo sapiens
gagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaacgcagccccttgccaccagcggtgcctcgggctgcccggcgcgccgcctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggtctttttctgatcccagaaagactaactaaaagtctggaacctttaaaagtctgataagaaatatttaccatctaatctctctgaagcctgctacttggaggattcatctgcataataagaaccctggtctccacaaccccttatcttcattcagacattcctttctatattgattccagttctttagataataacttaacactttcaaccaattgccaatcagaaaatctttaaatccacctataactggaagctgccctgccaccatcactgctttgagttgttctgcctttctggaccaaaccaatgtacaccttatatgtatcaattgatgtctgcttgtaacttctgaccccctaaaatgtataagaccaagctgtaacccaaccatctgcgtacatgttctccgaccctcctgaagctgtgtcattggcatgcccttattcttgacaaaataaacttctaaattgattgagaaaaaaaatttaaaaaaataaaaacctgattttcttggtcagagctgg

SEQ ID NO: 731679 - DNA, 2043 bp, Homo sapiens
gagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaacgcagccccttgccaccagcggtgcctcgggctgcccggcgcgccgcctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggaaccttcactcagaagaaatgctgtggcccttccctttaccaacagaaaatggaacacaagagaccacatagctgaacaaattatagcctccttacaagtgagaaaccttcgaggctacatagttttcagccaaaggaaaataaccaacagcttctccacagtgtagactgaaacaagggaaacatgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttagactgtaaaaagctaaaaggcacgactttttccagagcctcatgagtggatgggggtaaggggtgcaacttattaattcttgaacatacttggttcaggagagtttgtaagtatgtgtggtcttgtttccttgtttgtttgtttgttttgttctgttttgtttgaggattgttatttggcgtgctgttttctacctctggtcttatctgtgatacataatttcaaataaacattatcatacaaaaacagaaa

SEQ ID NO: 731680 - DNA, 2104 bp, Homo sapiens
gagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaacgcagccccttgccaccagcggtgcctcgggctgcccggcgcgccgcctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggtgaggggcgcacaccttccgggacgaccttggcttcccttcttacccccacccactccaggaaccttcactcagaagaaatgctgtggcccttccctttaccaacagaaaatggaacacaagagaccacatagctgaacaaattatagcctccttacaagtgagaaaccttcgaggctacatagttttcagccaaaggaaaataaccaacagcttctccacagtgtagactgaaacaagggaaacatgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttagactgtaaaaagctaaaaggcacgactttttccagagcctcatgagtggatgggggtaaggggtgcaacttattaattcttgaacatacttggttcaggagagtttgtaagtatgtgtggtcttgtttccttgtttgtttgtttgttttgttctgttttgtttgaggattgttatttggcgtgctgttttctacctctggtcttatctgtgatacataatttcaaataaacattatcatacaaaaacagaaa

SEQ ID NO: 731681 - DNA, 2395 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatg

SEQ ID NO: 731682 - DNA, 2576 bp, Homo sapiens; identical to SEQ ID NO: 330233
  misc_feature (27)..(27): n is a, c, g, or t
  misc_feature (29)..(29): n is a, c, g, or t
  misc_feature (262)..(262): n is a, c, g, or t
  misc_feature (2570)..(2571): n is a, c, g, or t

SEQ ID NO: 731683 - DNA, 646 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaacaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattg

SEQ ID NO: 731684 - DNA, 2056 bp, Homo sapiens; identical to SEQ ID NO: 330240
  misc_feature (2050)..(2051): n is a, c, g, or t

SEQ ID NO: 731685 - DNA, 2006 bp, Homo sapiens
  misc_feature (2000)..(2001): n is a, c, g, or t
tctccctcttccttttctttctctctttcgttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731686 - DNA, 2522 bp, Homo sapiens; identical to SEQ ID NO: 330235
  misc_feature (27)..(27): n is a, c, g, or t
  misc_feature (29)..(29): n is a, c, g, or t
  misc_feature (262)..(262): n is a, c, g, or t
  misc_feature (2516)..(2517): n is a, c, g, or t

SEQ ID NO: 731687 - DNA, 2472 bp, Homo sapiens; identical to SEQ ID NO: 330236
  misc_feature (27)..(27): n is a, c, g, or t
  misc_feature (29)..(29): n is a, c, g, or t
  misc_feature (262)..(262): n is a, c, g, or t
  misc_feature (2466)..(2467): n is a, c, g, or t

SEQ ID NO: 731688 - DNA, 2526 bp, Homo sapiens; identical to SEQ ID NO: 330238
  misc_feature (27)..(27): n is a, c, g, or t
  misc_feature (29)..(29): n is a, c, g, or t
  misc_feature (262)..(262): n is a, c, g, or t
  misc_feature (2520)..(2521): n is a, c, g, or t

SEQ ID NO: 731689 - DNA, 1277 bp, Homo sapiens; identical to SEQ ID NO: 330245
  misc_feature (46)..(46): n is a, c, g, or t
  misc_feature (1271)..(1272): n is a, c, g, or t

SEQ ID NO: 731690 - DNA, 1043 bp, Homo sapiens
  misc_feature (46)..(46): n is a, c, g, or t
gtagggcgggaatggggggggggggggctggtaggtagtgggtcgntctggcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731691 - DNA, 1822 bp, Homo sapiens
tctccctcttccttttctttctctctttcgttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731692 - DNA, 1772 bp, Homo sapiens
tctccctcttccttttctttctctctttcgttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731693 - DNA, 2002 bp, Homo sapiens
  misc_feature (1996)..(1997): n is a, c, g, or t
tctccctcttccttttctttctctctttcgttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacattatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731694 - DNA, 2140 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2134)..(2135): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731695 - DNA, 1906 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731696 - DNA, 2086 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2080)..(2081): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacattatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731697 - DNA, 2288 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731698 - DNA, 2468 bp, Homo sapiens; identical to SEQ ID NO: 330237
  misc_feature (27)..(27): n is a, c, g, or t
  misc_feature (29)..(29): n is a, c, g, or t
  misc_feature (262)..(262): n is a, c, g, or t
  misc_feature (2462)..(2463): n is a, c, g, or t

SEQ ID NO: 731699 - DNA, 2238 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731700 - DNA, 2235 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731701 - DNA, 2469 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2463)..(2464): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731702 - DNA, 2519 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2513)..(2514): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731703 - DNA, 2285 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731704 - DNA, 2465 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2459)..(2460): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacattatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731705 - DNA, 2510 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2504)..(2505): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731706 - DNA, 2276 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731707 - DNA, 2226 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731708 - DNA, 2460 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2454)..(2455): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731709 - DNA, 2456 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2450)..(2451): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacattatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731710 - DNA, 2342 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731711 - DNA, 2522 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2516)..(2517): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacattatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731712 - DNA, 2292 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731713 - DNA, 2189 bp, Homo sapiens; identical to SEQ ID NO: 330243
  misc_feature (2183)..(2184): n is a, c, g, or t

SEQ ID NO: 731714 - DNA, 1955 bp, Homo sapiens
gatagtttcatggtgtgaggacccagactacttcttggggaagaaacctgaggaaatatccccactgacatgaactccccaatttgcaaacgtgtcagtcacaacatatcagaaggaagttcaataaaaagaaaatacaagcattattttttaagctacaccatgtaaacttagtatataagccctgcaatgtattatacaacttcaatatccccataaggaatactcctcaagttaggagatagaggttgaagtggggtttgagcctcacacccttctattcatatcctcgaacacaaaccttttctcctagaattctcaattatggaatacattcataaggaatgctaagtggcagccaggtggctggtaatcagcctaggggtagacaccagagtgaggcctcctgctccttctctggcccactgagaataccacctgactgcccacacagatggaaaggtggcaatgaggaaggcagaagttgggcctcatcaggtgtgtccaccatatgggcacaggaagcacaagagagggcaggcccttctaccacccaactgcaaagaagcaaggaagtggggggaaggggatgggatacaatgactgactagcctgttgaggtgtagtgatcctgccccagagtgaggaaaggacacagagattctccttccacaggtaggggtgtcttccagtcctgggtgaagtaatgtttgagataaggactgctctgtcgttgaggcttatccccctctttgtgtctacatgtggagttacccagaaataagaacatctgggttcttaaaaagtagcatcccaacacaccaactttgatgcccactccctccttcgatgctcaactttgccctcagctataggagatccgagaacagtgactattccaagactaaaacctgactccctccttggtacattctaattctcctcaacagcaccactgagtaacaaggacgctgcctaaggtaagtaagggtcctcaattccccccaagtttactagcacatgcataaaatattattaacaccatgaatggaagaggatgacgggataaaagaaattaggcttaataaagtgaatgtctataaaggaagaccagatcctgaaatgaaaaggcaaaacttatttgtgagctttggttaaatttatcatgaaaattacacttattaatgttttattgttattaacagcatcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731715 - DNA, 384 bp, Homo sapiens
attttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcc

SEQ ID NO: 731716 - DNA, 2662 bp, Homo sapiens; identical to SEQ ID NO: 330241
  misc_feature (27)..(27): n is a, c, g, or t
  misc_feature (29)..(29): n is a, c, g, or t
  misc_feature (262)..(262): n is a, c, g, or t
  misc_feature (2656)..(2657): n is a, c, g, or t

SEQ ID NO: 731717 - DNA, 2428 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731718 - DNA, 2608 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2602)..(2603): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacattatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731719 - DNA, 2378 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731720 - DNA, 2612 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2606)..(2607): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731721 - DNA, 2716 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2710)..(2711): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731722 - DNA, 2482 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731723 - DNA, 2662 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2656)..(2657): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacattatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731724 - DNA, 2432 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731725 - DNA, 2666 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2660)..(2661): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731726 - DNA, 2346 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731727 - DNA, 2580 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2574)..(2575): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731728 - DNA, 2366 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731729 - DNA, 2600 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2594)..(2595): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731730 - DNA, 2099 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2093)..(2094): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731731 - DNA, 2149 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731732 - DNA, 2383 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2377)..(2378): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731733 - DNA, 2140 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731734 - DNA, 2374 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2368)..(2369): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731735 - DNA, 2206 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731736 - DNA, 2440 bp, Homo sapiens; identical to SEQ ID NO: 330239
  misc_feature (27)..(27): n is a, c, g, or t
  misc_feature (29)..(29): n is a, c, g, or t
  misc_feature (262)..(262): n is a, c, g, or t
  misc_feature (2434)..(2435): n is a, c, g, or t

SEQ ID NO: 731737 - DNA, 1856 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731738 - DNA, 2090 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2084)..(2085): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731739 - DNA, 2243 bp, Homo sapiens; identical to SEQ ID NO: 330242
  misc_feature (2237)..(2238): n is a, c, g, or t

SEQ ID NO: 731740 - DNA, 2009 bp, Homo sapiens
gatagtttcatggtgtgaggacccagactacttcttggggaagaaacctgaggaaatatccccactgacatgaactccccaatttgcaaacgtgtcagtcacaacatatcagaaggaagttcaataaaaagaaaatacaagcattattttttaagctacaccatgtaaacttagtatataagccctgcaatgtattatacaacttcaatatccccataaggaatactcctcaagttaggagatagaggttgaagtggggtttgagcctcacacccttctattcatatcctcgaacacaaaccttttctcctagaattctcaattatggaatacattcataaggaatgctaagtggcagccaggtggctggtaatcagcctaggggtagacaccagagtgaggcctcctgctccttctctggcccactgagaataccacctgactgcccacacagatggaaaggtggcaatgaggaaggcagaagttgggcctcatcaggtgtgtccaccatatgggcacaggaagcacaagagagggcaggcccttctaccacccaactgcaaagaagcaaggaagtggggggaaggggatgggatacaatgactgactagcctgttgaggtgtagtgatcctgccccagagtgaggaaaggacacagagattctccttccacaggtaggggtgtcttccagtcctgggtgaagaaaacatttatgcatagcaccctgctcatagcaggggttccacagttccagcagtaatgtttgagataaggactgctctgtcgttgaggcttatccccctctttgtgtctacatgtggagttacccagaaataagaacatctgggttcttaaaaagtagcatcccaacacaccaactttgatgcccactccctccttcgatgctcaactttgccctcagctataggagatccgagaacagtgactattccaagactaaaacctgactccctccttggtacattctaattctcctcaacagcaccactgagtaacaaggacgctgcctaaggtaagtaagggtcctcaattccccccaagtttactagcacatgcataaaatattattaacaccatgaatggaagaggatgacgggataaaagaaattaggcttaataaagtgaatgtctataaaggaagaccagatcctgaaatgaaaaggcaaaacttatttgtgagctttggttaaatttatcatgaaaattacacttattaatgttttattgttattaacagcatcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731741 - DNA, 1969 bp, Homo sapiens
gatagtttcatggtgtgaggacccagactacttcttggggaagaaacctgaggaaatatccccactgacatgaactccccaatttgcaaacgtgtcagtcacaacatatcagaaggaagttcaataaaaagaaaatacaagcattattttttaagctacaccatgtaaacttagtatataagccctgcaatgtattatacaacttcaatatccccataaggaatactcctcaagttaggagatagaggttgaagtggggtttgagcctcacacccttctattcatatcctcgaacacaaaccttttctcctagaattctcaattatggaatacattcataaggaatgctaagtggcagccaggtggctggtaatcagcctaggggtagacaccagagtgaggcctcctgctccttctctggcccactgagaataccacctgactgcccacacagatggaaaggtggcaatgaggaaggcagaagttgggcctcatcaggtgtgtccaccatatgggcacaggaagcacaagagagggcaggcccttctaccacccaactgcaaagaagcaaggaagtggggggaaggggatgggatacaatgactgactagcctgttgaggtgtagtgatcctgccccagagtgaggaaaggacacagagattctccttccacaggtaggggtgtcttccagtcctgggtgaagaaaacatttatgcatagcaccctgctcatagcaggggttccacagttccagcagtaatgtttgagataaggactgctctgtcgttgaggcttatccccctctttgtgtctacatgtggagttacccagaaataagaacatctgggttcttaaaaagtagcatcccaacacaccaactttgatgcccactccctccttcgatgctcaactttgccctcagctataggagatccgagaacagtgactattccaagactaaaacctgactccctccttggtacattctaattctcctcaacagcaccactgagtaacaaggacgctgcctaaggtaagtaagggtcctcaattccccccaagtttactagcacatgcataaaatattattaacaccatgaatggaagaggatgacgggataaaagaaattaggcttaataaagtgaatgtctataaaggaagaccagatcctgaaatgaaaaggcaaaacttatttgtgagctttggttaaatttatcatgcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731742 - DNA, 2203 bp, Homo sapiens; identical to SEQ ID NO: 330244
  misc_feature (2197)..(2198): n is a, c, g, or t

SEQ ID NO: 731743 - DNA, 2650 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2644)..(2645): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731744 - DNA, 2416 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatg

SEQ ID NO: 731745 - DNA, 2596 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2590)..(2591): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggttgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacattatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 731746 - DNA, 920 bp, Homo sapiens
agcacggccacagtcaccatcccgatttttgctacaaatgaaaattactgtataatgagctccttaacacttttctttaaacctgtgtttggaagacttgtgttggtgtggccctgtgccctaatacctgtgaaatcacagcaccgatgagctggttccaatttttaaaatatatacatgcagtacttccatgactattcaaagaaaaacaattccttccatttgccacctgagatgaccaccagggatgtgaactacctcctgccccatccccagccccaggatcctgggacagggcttatgaacgcaaccactgtagtcagctcacttgatccacagcctggcacctccactgtctggctagggagcctcgaatgggtcccaaggccaccctgctcctcagttacatcatctgcatagtagtggtggttgtgaggaattcaggagctgcagcataagggccctgcaggtactatgtgctcagtaaatgccagtggttcttaagggtctgagctcccatggtagaggcaagtaagctgaggttcagagacagaaaatgacttgcccaagatcacccagctgggaagtgacagtgccagggttggagccctggttgagctggttccacaggccagagctcattctgccctctccccggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaaaaaaaaagt

SEQ ID NO: 731747 - DNA, 1063 bp, Homo sapiens
  misc_feature (982)..(984): n is a, c, g, or t
  misc_feature (991)..(991): n is a, c, g, or t
  misc_feature (1007)..(1007): n is a, c, g, or t
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctacaaaaaaaaacaaaacaacaaaaaaaattttgggggcgcatgggcccggaaagattttaaaacacnnnttgttgnggggggggggcccagntggttgtgcaaagtgggcaaaggggtgtccaggaaaatgggcaaagaaatggggga

SEQ ID NO: 731748 - DNA, 916 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagcta

SEQ ID NO: 731749 - DNA, 745 bp, Homo sapiens
  misc_feature (31)..(31): n is a, c, g, or t
  misc_feature (35)..(35): n is a, c, g, or t
  misc_feature (38)..(38): n is a, c, g, or t
  misc_feature (42)..(43): n is a, c, g, or t
  misc_feature (46)..(46): n is a, c, g, or t
  misc_feature (53)..(53): n is a, c, g, or t
  misc_feature (60)..(60): n is a, c, g, or t
  misc_feature (62)..(62): n is a, c, g, or t
  misc_feature (66)..(66): n is a, c, g, or t
  misc_feature (83)..(84): n is a, c, g, or t
  misc_feature (99)..(99): n is a, c, g, or t
  misc_feature (108)..(109): n is a, c, g, or t
aaggtttttgaaaaaaaaaaaaaccgccganccantangccnntcngggtctncaatctnanctcnaccttgctgaagccagnnccattgtgtccaacntagtcgggnnccatcacaacgcaccctgaccagatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagcta

SEQ ID NO: 731750 - DNA, 857 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagcta

SEQ ID NO: 731751 - DNA, 1004 bp, Homo sapiens
  misc_feature (923)..(925): n is a, c, g, or t
  misc_feature (932)..(932): n is a, c, g, or t
  misc_feature (948)..(948): n is a, c, g, or t
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctacaaaaaaaaacaaaacaacaaaaaaaattttgggggcgcatgggcccggaaagattttaaaacacnnnttgttgnggggggggggcccagntggttgtgcaaagtgggcaaaggggtgtccaggaaaatgggcaaagaaatggggga

SEQ ID NO: 731752 - DNA, 819 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaagggggaatcctagcaggacacagccttggatcaggacagagacttgggggccatcctgcccctccaacccgacatgtgtacctcagctttt

SEQ ID NO: 731753 - DNA, 881 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagcta

SEQ ID NO: 731754 - DNA, 926 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttactttacccccaacaagacagaggacacgatctttctcagagagtaccagacccgccagaaccagtgcttctataactccagttacctgaatgtccagcgggagaatgggaccgtctccagatacgagggaggccgagaacatgttgctcacctgctgttccttagggacaccaagaccttgatgtttggttcctacctggacgatgagaagaactgggggctgtctttctatgctgacaagccagagacgaccaaggagcaactgggagagttctacgaagctctcgactgcttgtgcattcccaggtcagatgtcatgtacaccgactggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaaaaaaaaagt

SEQ ID NO: 731755 - DNA, 892 bp, Homo sapiens
  misc_feature (31)..(31): n is a, c, g, or t
  misc_feature (35)..(35): n is a, c, g, or t
  misc_feature (38)..(38): n is a, c, g, or t
  misc_feature (42)..(43): n is a, c, g, or t
  misc_feature (46)..(46): n is a, c, g, or t
  misc_feature (53)..(53): n is a, c, g, or t
  misc_feature (60)..(60): n is a, c, g, or t
  misc_feature (62)..(62): n is a, c, g, or t
  misc_feature (66)..(66): n is a, c, g, or t
  misc_feature (83)..(84): n is a, c, g, or t
  misc_feature (99)..(99): n is a, c, g, or t
  misc_feature (108)..(109): n is a, c, g, or t
  misc_feature (811)..(813): n is a, c, g, or t
  misc_feature (820)..(820): n is a, c, g, or t
  misc_feature (836)..(836): n is a, c, g, or t
aaggtttttgaaaaaaaaaaaaaccgccganccantangccnntcngggtctncaatctnanctcnaccttgctgaagccagnnccattgtgtccaacntagtcgggnnccatcacaacgcaccctgaccagatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctacaaaaaaaaacaaaacaacaaaaaaaattttgggggcgcatgggcccggaaagattttaaaacacnnnttgttgnggggggggggcccagntggttgtgcaaagtgggcaaaggggtgtccaggaaaatgggcaaagaaatggggga

SEQ ID NO: 731756 - DNA, 830 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaagaggtaaacgcaagggattggacagtgcccaccttgtccatggcccaacttgggcagccccagaggcccagagcaggagagctgccaggcaaggctgcacag

SEQ ID NO: 731757 - DNA, 802 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttactttacccccaacaagacagaggacacgatctttctcagagagtaccagacccgccagaaccagtgcttctataactccagttacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggccaaaaaaaa

SEQ ID NO: 731758 - DNA, 855 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttactttacccccaacaagacagaggacacgatctttctcagagagtaccagacccgagggaggccgagaacatgttgctcacctgctgttccttagggacaccaagaccttgatgtttggttcctacctggacgatgagaagaactgggggctgtctttctatgctgacaagccagagacgaccaaggagcaactgggagagttctacgaagctctcgactgcttgtgcattcccaggtcagatgtcatgtacaccgactggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaaaaaaaaagt

SEQ ID NO: 731759 - DNA, 871 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttactttacccccaacaagacagaggacacgatctttctcagagagtaccagacccgccagaaccagtgcttctataactccagttacctgaatgtccagcgggagaatgggaccgtctccagatacgagggaggccgagaacatgttgctcacctgctgttccttagggacaccaagaccttgatgtttggttcctacctggacgatgagaagaactgggggctgtctttctatgcttgcgcattcccaagtcagattgtcgtgtacaccgattggacacacaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaaaaaaaaagt

SEQ ID NO: 731760 - DNA, 862 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggactccctcacttgcatcaataaagcttctgtgtttggaacagcta

SEQ ID NO: 731761 - DNA, 658 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaag

SEQ ID NO: 731762 - DNA, 867 bp, Homo sapiens
agcacggccacagtcaccatcccgatttttgctacaaatgaaaattactgtataatgagctccttaacacttttctttaaacctgtgtttggaagacttgtgttggtgtggccctgtgccctaatacctgtgaaatcacagcaccgatgagctggttccaatttttaaaatatatacatgcagtacttccatgactattcaaagaaaaacaattccttccatttgccacctgagatgaccaccagggatgtgaactacctcctgccccatccccagccccaggatcctgggacagggcttatgaacgcaaccactgtagtcagctcacttgatccacagcctggcacctccactgtctggctagggagcctcgaatgggtcccaaggccaccctgctcctcagttacatcatctgcatagtagtggtggttgtgaggaattcaggagctgcagcataagggccctgcaggtactatgtgctcagtaaatgccagtggttcttaagggtctgagctcccatggtagaggcaagtaagctgaggttcagagacagaccctggttgagctggttccacaggccagagctcattctgccctctccccggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaaaaaaaaagt

SEQ ID NO: 731763 - DNA, 1759 bp, Homo sapiens
aggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaa

SEQ ID NO: 731764 - DNA, 1370 bp, Homo sapiens
aggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccattccaagtctccacccctttctagaccaataaagagacgaatacaa

SEQ ID NO: 731765 - DNA, 1592 bp, Homo sapiens
aggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaa

SEQ ID NO: 731766 - DNA, 1203 bp, Homo sapiens
aggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccattccaagtctccacccctttctagaccaataaagagacgaatacaa

SEQ ID NO: 731767 - DNA, 1839 bp, Homo sapiens
cccagcagcagttcggcttaggactcgggttgcggcgggtgtcaccttctcaggggctagcaaggcagccagggcccaggcgtctgagtgaggggcgggagaggaggcgaggcagaaagtggaccttccagcggaaaggccattttccccaaggccgagcccagggaagtcccttcctatagaattcaggcagggtgggaggcagggcgcgctcgtgcccctcagccagctgcaggtgctctctgtccccaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaa

SEQ ID NO: 731768 - DNA, 1450 bp, Homo sapiens
cccagcagcagttcggcttaggactcgggttgcggcgggtgtcaccttctcaggggctagcaaggcagccagggcccaggcgtctgagtgaggggcgggagaggaggcgaggcagaaagtggaccttccagcggaaaggccattttccccaaggccgagcccagggaagtcccttcctatagaattcaggcagggtgggaggcagggcgcgctcgtgcccctcagccagctgcaggtgctctctgtccccaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccattccaagtctccacccctttctagaccaataaagagacgaatacaa

SEQ ID NO: 731769 - DNA, 1739 bp, Homo sapiens
cccagcagcagttcggcttaggactcgggttgcggcgggtgtcaccttctcaggggctagcaaggcagccagggcccaggcgtctgagtgaggggcgggagaggaggcgaggcagaaagtggaccttccagcggaaaggccattttccccaaggccgagcccagggaagtcccttcctatagaattcaggcagggtgggaggcagggcgcgctcgtgcccctcagccagctgcaggtgctctctgtccccaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaagggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaa

SEQ ID NO: 731770 - DNA, 1659 bp, Homo sapiens
aggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaagggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaa

SEQ ID NO: 731771 - DNA, 1518 bp, Homo sapiens
aggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcagatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaa

SEQ ID NO: 731772 - DNA, 1129 bp, Homo sapiens
aggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcagatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccattccaagtctccacccctttctagaccaataaagagacgaatacaa

SEQ ID NO: 731773 - DNA, 1418 bp, Homo sapiens
aggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcagatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaagggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaa

SEQ ID NO: 731774 - DNA, 1843 bp, Homo sapiens
  misc_feature (324)..(324): n is a, c, g, or t
cccagcagcagttcggcttaggactcgggttgcggcgggtgtcaccttctcaggggctagcaaggcagccagggcccaggcgtctgagtgaggggcgggagaggaggcgaggcagaaagtggaccttccagcggaaaggccattttccccaaggccgagcccagggaagtcccttcctatagaattcaggcagggtgggaggcagggcgcgctcgtgcccctcagccagctgcaggtgctctctgtccccaggcgccatgagcaagatcagcgaggccgtgaagcgcgcccgcgccgccttcagctcgggcagagggggggagnggggaacaaaaaaagaaaaagaaatcccctgcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaa

SEQ ID NO: 731775 - DNA, 1454 bp, Homo sapiens
  misc_feature (324)..(324): n is a, c, g, or t
cccagcagcagttcggcttaggactcgggttgcggcgggtgtcaccttctcaggggctagcaaggcagccagggcccaggcgtctgagtgaggggcgggagaggaggcgaggcagaaagtggaccttccagcggaaaggccattttccccaaggccgagcccagggaagtcccttcctatagaattcaggcagggtgggaggcagggcgcgctcgtgcccctcagccagctgcaggtgctctctgtccccaggcgccatgagcaagatcagcgaggccgtgaagcgcgcccgcgccgccttcagctcgggcagagggggggagnggggaacaaaaaaagaaaaagaaatcccctgcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccattccaagtctccacccctttctagaccaataaagagacgaatacaa

SEQ ID NO: 731776 - DNA, 1492 bp, Homo sapiens
aggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaagggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaa

SEQ ID NO: 731777 - DNA, 1743 bp, Homo sapiens
  misc_feature (324)..(324): n is a, c, g, or t
cccagcagcagttcggcttaggactcgggttgcggcgggtgtcaccttctcaggggctagcaaggcagccagggcccaggcgtctgagtgaggggcgggagaggaggcgaggcagaaagtggaccttccagcggaaaggccattttccccaaggccgagcccagggaagtcccttcctatagaattcaggcagggtgggaggcagggcgcgctcgtgcccctcagccagctgcaggtgctctctgtccccaggcgccatgagcaagatcagcgaggccgtgaagcgcgcccgcgccgccttcagctcgggcagagggggggagnggggaacaaaaaaagaaaaagaaatcccctgcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaagggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaa

SEQ ID NO: 731778 - DNA, 2779 bp, Homo sapiens; identical to SEQ ID NO: 376791

SEQ ID NO: 731779 - DNA, 1416 bp, Homo sapiens; identical to SEQ ID NO: 376795

SEQ ID NO: 731780 - DNA, 2855 bp, Homo sapiens
cagcctggagtgcagctcatactccatgcccagaattcctgcctcgccactgtcctgctgccctccagacatgctggggccctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcaggtgagctggggcccgctgctgggtcacggccaggtcacagacgttggtcacatatactgacctctgacacccttagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaatgccagt

SEQ ID NO: 731781 - DNA, 1492 bp, Homo sapiens
cagcctggagtgcagctcatactccatgcccagaattcctgcctcgccactgtcctgctgccctccagacatgctggggccctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcaggtgagctggggcccgctgctgggtcacggccaggtcacagacgttggtcacatatactgacctctgacacccttagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcggtgagtgccgcggggtggccccctgagggggaccagg

SEQ ID NO: 731782 - DNA, 2655 bp, Homo sapiens
tctttgctctccccctggccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaatgccagt

SEQ ID NO: 731783 - DNA, 1292 bp, Homo sapiens
tctttgctctccccctggccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcggtgagtgccgcggggtggccccctgagggggaccagg

SEQ ID NO: 731784 - DNA, 2435 bp, Homo sapiens; identical to SEQ ID NO: 376793

SEQ ID NO: 731785 - DNA, 1072 bp, Homo sapiens
ccccagagaagagctcagagtgtctctgtccccagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcggtgagtgccgcggggtggccccctgagggggaccagg

SEQ ID NO: 731786 - DNA, 2389 bp, Homo sapiens; identical to SEQ ID NO: 376798
  misc_feature (23)..(23): n is a, c, g, or t

SEQ ID NO: 731787 - DNA, 1026 bp, Homo sapiens
  misc_feature (23)..(23): n is a, c, g, or t
cccgccgtaccaagttgcgcccnccgtaccagttgcggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcggtgagtgccgcggggtggccccctgagggggaccagg

SEQ ID NO: 731788 - DNA, 757 bp, Homo sapiens; identical to SEQ ID NO: 376796

SEQ ID NO: 731789 - DNA, 2469 bp, Homo sapiens
cagcctggagtgcagctcatactccatgcccagaattcctgcctcgccactgtcctgctgccctccagacatgctggggccctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcgccaggtgcagtggctcatgcctgtaatcccagcac

SEQ ID NO: 731790 - DNA, 854 bp, Homo sapiens
cagcctggagtgcagctcatactccatgcccagaattcctgcctcgccactgtcctgctgccctccagacatgctggggccctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcccatggggaccccagaccctgagtacccagatgactacagccaaggtgggaccaggctggacgggaagaatctggtgcaggaatggctggcga

SEQ ID NO: 731791 - DNA, 2545 bp, Homo sapiens
cagcctggagtgcagctcatactccatgcccagaattcctgcctcgccactgtcctgctgccctccagacatgctggggccctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcaggtgagctggggcccgctgctgggtcacggccaggtcacagacgttggtcacatatactgacctctgacacccttagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcgccaggtgcagtggctcatgcctgtaatcccagcac

SEQ ID NO: 731792 - DNA, 730 bp, Homo sapiens
tctttgctctccccctggccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcccatggggaccccagaccctgagtacccagatgactacagccaaggtgggaccaggctggacgggaagaatctggtgcaggaatggctggcga

SEQ ID NO: 731793 - DNA, 2345 bp, Homo sapiens
tctttgctctccccctggccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcgccaggtgcagtggctcatgcctgtaatcccagcac

SEQ ID NO: 731794 - DNA, 1834 bp, Homo sapiens; identical to SEQ ID NO: 376794

SEQ ID NO: 731795 - DNA, 1524 bp, Homo sapiens
cggtacccatcaggcgaagactgtggcacgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcgccaggtgcagtggctcatgcctgtaatcccagcac

SEQ ID NO: 731796 - DNA, 471 bp, Homo sapiens
cggtacccatcaggcgaagactgtggcacgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcggtgagtgccgcggggtggccccctgagggggaccagg

SEQ ID NO: 731797 - DNA, 2125 bp, Homo sapiens
ccccagagaagagctcagagtgtctctgtccccagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcgccaggtgcagtggctcatgcctgtaatcccagcac

SEQ ID NO: 731798 - DNA, 2079 bp, Homo sapiens
  misc_feature (23)..(23): n is a, c, g, or t
cccgccgtaccaagttgcgcccnccgtaccagttgcggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcgccaggtgcagtggctcatgcctgtaatcccagcac

SEQ ID NO: 731799 - DNA, 623 bp, Homo sapiens; identical to SEQ ID NO: 312040

SEQ ID NO: 731800 - DNA, 1491 bp, Homo sapiens
ggggtatataagagctggattactagttagcaaatgagggggtaaatattccagtggatacaagcttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactaaaaatacaaaaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaaaaaaaaact

SEQ ID NO: 731801 - DNA, 1409 bp, Homo sapiens
aagctttgcacatctccaggtcagacctatcctaatatctacatctacatttccagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactaaaaatacaaaaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaaaaaaaaact

SEQ ID NO: 731802 - DNA, 541 bp, Homo sapiens
aagctttgcacatctccaggtcagacctatcctaatatctacatctacatttccagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatg

SEQ ID NO: 731803 - DNA, 1583 bp, Homo sapiens
ggggtatataagagctggattactagttagcaaatgagggggtaaatattccagtggatacaagcttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagacaggaatggataattccagttttgtcaagaaatatactcttggaacttagaggggcaaagccagaacatgaagcgggaaaaaaatcaaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactaaaaatacaaaaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaaaaaaaaact

SEQ ID NO: 731804 - DNA, 715 bp, Homo sapiens
ggggtatataagagctggattactagttagcaaatgagggggtaaatattccagtggatacaagcttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagacaggaatggataattccagttttgtcaagaaatatactcttggaacttagaggggcaaagccagaacatgaagcgggaaaaaaatcaaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatg

SEQ ID NO: 731805 - DNA, 581 bp, Homo sapiens
gaaggctcagtataaatagcagccaccgctccctggcaggcagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtg

SEQ ID NO: 731806 - DNA, 851 bp, Homo sapiens
  misc_feature (688)..(688): n is a, c, g, or t
  misc_feature (693)..(693): n is a, c, g, or t
  misc_feature (703)..(703): n is a, c, g, or t
gaaggctcagtataaatagcagccaccgctccctggcaggcagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtgcaaaaaaaaaaacaaaaacaaaaaaaaactttttgggccgcctgggcccctggaaaaaagtttttaaaaccctttcgttgtgggccgggggccccaatggttacgcnaccgnggcaaagcgngtcccaagaaaaaccgggccagaaagggcgggggattcccccgaagtaaaaagagcccggggcaaaccgggggttcggaaccaaccccaaggggatccggaggccacgaggagcctacacgggggtcccaagggagccgaataaaaca

SEQ ID NO: 731807 - DNA, 985 bp, Homo sapiens
gaaggctcagtataaatagcagccaccgctccctggcaggcagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcaggctgaagtgccatggcatgatcatggctcactgcaacctcgacctcccggggctcaagagatcctcccacttcagcctcttgaataactgggactgcagatgtgcgccatgacacttgcctaatttttatattttttgtagagatggggtttcgccgtgtcacccaggctggtcttgaactcctgggctcaagtgatctgcctgcctcagcctcccaaagtgctgggattacaggcatgagtcactgagcccagcctactgttatatttattttgtgtcggtttgaggctgcccagattcacattgtttctggggtcgtctgtgagggtgtttccagaggagattaacatttgaattggacttaataaagtagattgctattctcaatgcaactgggcatcacccaatctgttgaaggcttgaatagaacaaaaatagaggaaggacagatttgcctcccttttccccgcctcactgcttgagttggacatctcctctcatcttctcttgccctcaaattggatttacatgatcagttgctctggttctcaggcctttgaactcagactgaattacactttcctgagtttctagcttgcagagggcagatcgtgggacttctcagccccaattatcttgtgagccaattccttacaataaataaatacatacataca

SEQ ID NO: 731808 - DNA, 726 bp, Homo sapiens
gaaggctcagtataaatagcagccaccgctccctggcaggcagggacccgcagctcagctacagcacagatcaggaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtg

SEQ ID NO: 731809 - DNA, 770 bp, Homo sapiens
  misc_feature (584)..(584): n is a, c, g, or t
gaaggctcagtataaatagcagccaccgctccctggcaggcagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtgaanaaaagaaaaaaaaaaaaaaaaaaaaaaaaaaaacaatggtcggtacggactgaggccctcgagaaagctcgaagaacacatcggttgggcgaggggacccacaagatacagggacacagggccaaaagcggtcccaaaggagaaccggggccaagaacaggggcggggattcccaccaattaaaag

SEQ ID NO: 731810 - DNA, 642 bp, Homo sapiens
gaaggctcagtataaatagcagccaccgctccctggcaggcagggacccgcagctcagctacagcacagatcagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtg

SEQ ID NO: 731811 - DNA, 504 bp, Homo sapiens
tgggcgactgcctgacttctcctttcatttcagcaccatgaagcttctcacgggcctggttttctgctccttggtcctgagtgtcagcagccgaagcttcttttcgttccttggcgaggcttttgatggtaaggcttcagaaggtttgcaggatttctgaagagaaacatcgccctggacctgataaactggggaaaatgatgctttcggaaggctgcttttgaaccacagagttgctagtgtctgcgtttgctgaggcctgccaggaactagggtttgctgggttgcctgtctcgagtctttcagagctgctgggaatatcccctttccccgtagtgcagcttctcaggatgtgttaagtggatggatcacatttcagaagccgctgcaaggtgtatcaaaaacacatctcctgagccgtaagggacggggcatccagtaacaacgcacacggggtatttttgggcttccttaagatttgagccgctgccttaggttgtgctg

SEQ ID NO: 731812 - DNA, 825 bp, Homo sapiens
  misc_feature (662)..(662): n is a, c, g, or t
  misc_feature (667)..(667): n is a, c, g, or t
  misc_feature (677)..(677): n is a, c, g, or t
gaaggctcagtataaatagcagccaccgctccctggcaggcagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagcggggagagggtacacaatgggtatctaataaatacttaagaggtcaaaaaaaaaaacaaaaacaaaaaaaaactttttgggccgcctgggcccctggaaaaaagtttttaaaaccctttcgttgtgggccgggggccccaatggttacgcnaccgnggcaaagcgngtcccaagaaaaaccgggccagaaagggcgggggattcccccgaagtaaaaagagcccggggcaaaccgggggttcggaaccaaccccaaggggatccggaggccacgaggagcctacacgggggtcccaagggagccgaataaaaca

SEQ ID NO: 731813 - DNA, 289 bp, Homo sapiens
gaaggctcagtataaatagcagccaccgctccctggcaggcagggacccgcagctcagctacagcacagatcaggaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggcttta

SEQ ID NO: 731814 - DNA, 906 bp, Homo sapiens
gaaggctcagtataaatagcagccaccgctccctggcaggcagggacccgcagctcagctacagcacagatcaggaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtgtcaaaacaaacaaaaaaaagcgaacacactgggcgggcccagggcaccgaaaaagtgcatgagacaatgcgagggagcaggggcccaaaatacggacatggcagaaggggaccaagagaccggacaaaaaagggtgggaccccacaagaaaacgccgggaacgagcgtgaaacaaccaag

SEQ ID NO: 731815 - DNA, 375 bp, Homo sapiens
acctctaagtatatagatacctatatataccatagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagagaagatgactgaggaatacaaccacaactggatggactttttcaaaagatgacacctgcttatttgcctcattcaaatttcaag

SEQ ID NO: 731816 - DNA, 996 bp, Homo sapiens
  misc_feature (833)..(833): n is a, c, g, or t
  misc_feature (838)..(838): n is a, c, g, or t
  misc_feature (848)..(848): n is a, c, g, or t
gaaggctcagtataaatagcagccaccgctccctggcaggcagggacccgcagctcagctacagcacagatcaggaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtgcaaaaaaaaaaacaaaaacaaaaaaaaactttttgggccgcctgggcccctggaaaaaagtttttaaaaccctttcgttgtgggccgggggccccaatggttacgcnaccgnggcaaagcgngtcccaagaaaaaccgggccagaaagggcgggggattcccccgaagtaaaaagagcccggggcaaaccgggggttcggaaccaaccccaaggggatccggaggccacgaggagcctacacgggggtcccaagggagccgaataaaaca

SEQ ID NO: 731817 - DNA, 833 bp, Homo sapiens
  misc_feature (670)..(670): n is a, c, g, or t
  misc_feature (675)..(675): n is a, c, g, or t
  misc_feature (685)..(685): n is a, c, g, or t
acctctaagtatatagatacctatatataccatagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtgcaaaaaaaaaaacaaaaacaaaaaaaaactttttgggccgcctgggcccctggaaaaaagtttttaaaaccctttcgttgtgggccgggggccccaatggttacgcnaccgnggcaaagcgngtcccaagaaaaaccgggccagaaagggcgggggattcccccgaagtaaaaagagcccggggcaaaccgggggttcggaaccaaccccaaggggatccggaggccacgaggagcctacacgggggtcccaagggagccgaataaaaca

SEQ ID NO: 731818 - DNA, 563 bp, Homo sapiens
acctctaagtatatagatacctatatataccatagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtg

SEQ ID NO: 731819 - DNA, 178 bp, Homo sapiens
tgcgacctttacaaatgagtacagcgtagctaggaggagcacaccaaggagtgatttttaaaacttactctgttttctctttcccaacaagattatcatttcctttaaaaaaaatagttatcctggggcatacagccataccattctgaaggtgtcttatctcctctgatctagagag

SEQ ID NO: 731820 - DNA, 342 bp, Homo sapiens
catataataggcatctaataaatgcttaagaggtgaatttgttgaaacagtgtgttcttcttttggtgctgactgcctgtttggtacaaaagggaaatcaatgcacacccacatgaagggtgagcctaggtaggcctatgtgtttggatgtgaggagacattcttagtagtcacagtgcagacacctgcatcaacccttccacaaattagacctccttttttccagacctttgtggttacattgttgctatttccagtcccttccttgcccaggcttctcatctcctgtgaattatttcctgttaccttctctgtccctcagttcttcattcctcagtgatc

SEQ ID NO: 731821 - DNA, 442 bp, Homo sapiens; identical to SEQ ID NO: 51565

SEQ ID NO: 731822 - DNA, 892 bp, Homo sapiens; identical to SEQ ID NO: 446339

SEQ ID NO: 731823 - DNA, 864 bp, Homo sapiens; identical to SEQ ID NO: 446338

SEQ ID NO: 731824 - DNA, 145 bp, Homo sapiens
gatcccagaggaggaagtccagagacagagcaccatgacttctgagaaaggagaagaatcgaaccctgggagtttgacgtcttctatgaccccagagaacttcgtaaagaggcctgtctgctctacgaaatcaagtggggcatga

SEQ ID NO: 731825 - DNA, 879 bp, Homo sapiens; identical to SEQ ID NO: 307399

SEQ ID NO: 731826 - DNA, 460 bp, Homo sapiens
gatcaagaggaccccttcagtgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731827 - DNA, 694 bp, Homo sapiens; identical to SEQ ID NO: 307400

SEQ ID NO: 731828 - DNA, 599 bp, Homo sapiens
gtatccagaggatcccttcagcacatttagtcaagtacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731829 - DNA, 563 bp, Homo sapiens; identical to SEQ ID NO: 307402

SEQ ID NO: 731830 - DNA, 469 bp, Homo sapiens
  misc_feature (24)..(24): n is a, c, g, or t
aaacagtgtatcaacgcagagtgnccattacggccgggattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731831 - DNA, 358 bp, Homo sapiens
cctcctgagtagctgggactacaggtgcccaccaccacgcccagctaattttttgtattttcagtagagacggggtttcaccgtgttagccaggatggtctcgatctcctgacctcatgatttgcccacctcagcctcccaaagtgctgggatcacagacgtcagcctataacctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731832 - DNA, 3021 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731833 - DNA, 2888 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttgg

SEQ ID NO: 731834 - DNA, 2981 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731835 - DNA, 3698 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731836 - DNA, 3088 bp, Homo sapiens
  misc_feature (24)..(24): n is a, c, g, or t
  misc_feature (3057)..(3059): n is a, c, g, or t
  misc_feature (3071)..(3072): n is a, c, g, or t
  misc_feature (3078)..(3078): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731837 - DNA, 2541 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttt

SEQ ID NO: 731838 - DNA, 2804 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731839 - DNA, 3521 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731840 - DNA, 2911 bp, Homo sapiens
  misc_feature (24)..(24): n is a, c, g, or t
  misc_feature (2880)..(2882): n is a, c, g, or t
  misc_feature (2894)..(2895): n is a, c, g, or t
  misc_feature (2901)..(2901): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731841 - DNA, 2844 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731842 - DNA, 2711 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttgg

SEQ ID NO: 731843 - DNA, 2364 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttt

SEQ ID NO: 731844 - DNA, 1062 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtaagaatttatcaaataaataatacatcttaaaaacaa

SEQ ID NO: 731845 - DNA, 1168 bp, Homo sapiens
  misc_feature (1130)..(1130): n is a, c, g, or t
  misc_feature (1165)..(1165): n is a, c, g, or t
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731846 - DNA, 1716 bp, Homo sapiens
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731847 - DNA, 1106 bp, Homo sapiens
  misc_feature (1075)..(1077): n is a, c, g, or t
  misc_feature (1089)..(1090): n is a, c, g, or t
  misc_feature (1096)..(1096): n is a, c, g, or t
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731848 - DNA, 1039 bp, Homo sapiens; identical to SEQ ID NO: 307433

SEQ ID NO: 731849 - DNA, 1384 bp, Homo sapiens
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaagcggaatacagcacattaagtcaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcatcaacaaaatgtatgtctggttccccagtagagctatactgcctcaacccaaggggatattttaatgtctggggcagaaacactcaagttgattagaaagaccagccaatgtcagtgtatctgggtccttaacccacttggctagtgtgaattatagtacaatgatatttttttttgtggagataggtcagaacatagaggg

SEQ ID NO: 731850 - DNA, 999 bp, Homo sapiens
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731851 - DNA, 906 bp, Homo sapiens
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttgg

SEQ ID NO: 731852 - DNA, 1053 bp, Homo sapiens
  misc_feature (1022)..(1024): n is a, c, g, or t
  misc_feature (1036)..(1037): n is a, c, g, or t
  misc_feature (1043)..(1043): n is a, c, g, or t
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731853 - DNA, 1663 bp, Homo sapiens
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731854 - DNA, 1115 bp, Homo sapiens
  misc_feature (1077)..(1077): n is a, c, g, or t
  misc_feature (1112)..(1112): n is a, c, g, or t
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731855 - DNA, 986 bp, Homo sapiens
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731856 - DNA, 946 bp, Homo sapiens
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731857 - DNA, 603 bp, Homo sapiens
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccattttaaaaaaaaaaaaaaaaaaaaaaaaaaaaaaaaaaaaaaaaaaat

SEQ ID NO: 731858 - DNA, 559 bp, Homo sapiens
aggaccccaattaggctggcgcacagtatgtacgctacccgatgatagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttt

SEQ ID NO: 731859 - DNA, 459 bp, Homo sapiens
ggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtgagtctgttcataatcgaag

SEQ ID NO: 731860 - DNA, 2772 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttgg

SEQ ID NO: 731861 - DNA, 381 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtgagtctgttcataatcgaag

SEQ ID NO: 731862 - DNA, 2865 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731863 - DNA, 3034 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (2996)..(2996): n is a, c, g, or t
  misc_feature (3031)..(3031): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731864 - DNA, 3582 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731865 - DNA, 2972 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (2941)..(2943): n is a, c, g, or t
  misc_feature (2955)..(2956): n is a, c, g, or t
  misc_feature (2962)..(2962): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731866 - DNA, 2905 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731867 - DNA, 3250 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaagcggaatacagcacattaagtcaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcatcaacaaaatgtatgtctggttccccagtagagctatactgcctcaacccaaggggatattttaatgtctggggcagaaacactcaagttgattagaaagaccagccaatgtcagtgtatctgggtccttaacccacttggctagtgtgaattatagtacaatgatatttttttttgtggagataggtcagaacatagaggg

SEQ ID NO: 731868 - DNA, 2919 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (2888)..(2890): n is a, c, g, or t
  misc_feature (2902)..(2903): n is a, c, g, or t
  misc_feature (2909)..(2909): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731869 - DNA, 3529 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731870 - DNA, 2981 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (2943)..(2943): n is a, c, g, or t
  misc_feature (2978)..(2978): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731871 - DNA, 2852 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731872 - DNA, 2812 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731873 - DNA, 2813 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731874 - DNA, 2920 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (2889)..(2891): n is a, c, g, or t
  misc_feature (2903)..(2904): n is a, c, g, or t
  misc_feature (2910)..(2910): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731875 - DNA, 2853 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731876 - DNA, 3530 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731877 - DNA, 2982 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (2944)..(2944): n is a, c, g, or t
  misc_feature (2979)..(2979): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731878 - DNA, 2469 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccattttaaaaaaaaaaaaaaaaaaaaaaaaaaaaaaaaaaaaaaaaaaat

SEQ ID NO: 731879 - DNA, 2425 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttt

SEQ ID NO: 731880 - DNA, 1372 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgtaagagcccttccttaaaactgagtgtgccactcttgaaaatgtc

SEQ ID NO: 731881 - DNA, 2052 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacggtactgaaattttcactctcacatcttgaccatctgtcctttactgaacaaggagctaggagggataacagaccaaaggaatcacatgccattttctacattgctcttgtttaaacatttctaagtactcctcgtttttttccctagtgtttctgctttgttcacttataaaatataaatttccataaagtaggggccagcatctactagccttttgtatctttcctcattactctaggaaatagaattctacccacagttgaaacttaacaaatgtgattagttcgtttggttattaacatatcctaccaccaatcaactttatatatttaaccatttccagttgttcttttgggcatgatatatacatacatatatacatacatacccacacatatatacacacactcctccctcaaagctactaaacatgaaaacattgtgcctatatgataaaaatgtcaatattgctggtgatactgatgctgatggaaatgacgatattagctgccattaacgtagtatctaatgtgtgccaaacaatattaaaaattgctgtatatacatgtttgccatttattatttataaccttaacaagatgtctcactcataagactactttccgcactatgatacagaaatgaatattaaaacatgtgcatgctcatgtcaaactcatagaacttgattttattttggcaggattaaaccaatttgcaacttgagtacaaatgccaatatttcagctagttcttgaaaagttgtgccattgtgcaaaagtcattgaattatttgataactttttaacctaatgaccaaacacctgacaggaatggaattcactggacttgtatctaattgttttacactgttttctatgggttacattttttattgccattgtgacctttatccacacactaacctggaaagtataggaataaaagaattggcattctttctgatacaccctttttgttttcttcttaaagtcatttatattatgtattactcttaaagaatgttttagtctccattttagtagtctgtgcataaggtagtaatacatgtacacaaagaaaaattcacaagcccattcaggtgtcttttagaacattatttaccactaaatatttatacagttgacataatgcttattatgcccttgaataatagaatttgttttgtttttacttcttatccataagcattggccttacattgcctcaagaggaacagaatttattattaaacaggattcttaaatccataactcatattgtgacttcatacattttgtaaccctagtagtgaatataccctaaaaacctataaatccccccaaatcactctactgatg

SEQ ID NO: 731882 - DNA, 2688 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731883 - DNA, 2857 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (2819)..(2819): n is a, c, g, or t
  misc_feature (2854)..(2854): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731884 - DNA, 3405 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731885 - DNA, 2795 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (2764)..(2766): n is a, c, g, or t
  misc_feature (2778)..(2779): n is a, c, g, or t
  misc_feature (2785)..(2785): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731886 - DNA, 2728 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731887 - DNA, 3073 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaagcggaatacagcacattaagtcaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcatcaacaaaatgtatgtctggttccccagtagagctatactgcctcaacccaaggggatattttaatgtctggggcagaaacactcaagttgattagaaagaccagccaatgtcagtgtatctgggtccttaacccacttggctagtgtgaattatagtacaatgatatttttttttgtggagataggtcagaacatagaggg

SEQ ID NO: 731888 - DNA, 2595 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttgg

SEQ ID NO: 731889 - DNA, 2742 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (2711)..(2713): n is a, c, g, or t
  misc_feature (2725)..(2726): n is a, c, g, or t
  misc_feature (2732)..(2732): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731890 - DNA, 3352 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731891 - DNA, 2804 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (2766)..(2766): n is a, c, g, or t
  misc_feature (2801)..(2801): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731892 - DNA, 2675 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731893 - DNA, 2635 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731894 - DNA, 2636 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731895 - DNA, 2743 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (2712)..(2714): n is a, c, g, or t
  misc_feature (2726)..(2727): n is a, c, g, or t
  misc_feature (2733)..(2733): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731896 - DNA, 2676 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731897 - DNA, 3353 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731898 - DNA, 2805 bp, Homo sapiens
  misc_feature (14)..(14): n is a, c, g, or t
  misc_feature (16)..(16): n is a, c, g, or t
  misc_feature (25)..(25): n is a, c, g, or t
  misc_feature (2767)..(2767): n is a, c, g, or t
  misc_feature (2802)..(2802): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731899 - DNA, 2292 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccattttaaaaaaaaaaaaaaaaaaaaaaaaaaaaaaaaaaaaaaaaaaat

SEQ ID NO: 731900 - DNA, 2248 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttt

SEQ ID NO: 731901 - DNA, 1195 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgtaagagcccttccttaaaactgagtgtgccactcttgaaaatgtc

SEQ ID NO: 731902 - DNA, 946 bp, Homo sapiens
  misc_feature (14)..(14): n is a, c, g, or t
  misc_feature (16)..(16): n is a, c, g, or t
  misc_feature (25)..(25): n is a, c, g, or t
cgcgtgggttcctngnagacgtcgngactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtaagaatttatcaaataaataatacatcttaaaaacaa

SEQ ID NO: 731903 - DNA, 3150 bp, Homo sapiens
  misc_feature (24)..(24): n is a, c, g, or t
  misc_feature (3112)..(3112): n is a, c, g, or t
  misc_feature (3147)..(3147): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731904 - DNA, 3366 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaagcggaatacagcacattaagtcaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcatcaacaaaatgtatgtctggttccccagtagagctatactgcctcaacccaaggggatattttaatgtctggggcagaaacactcaagttgattagaaagaccagccaatgtcagtgtatctgggtccttaacccacttggctagtgtgaattatagtacaatgatatttttttttgtggagataggtcagaacatagaggg

SEQ ID NO: 731905 - DNA, 3035 bp, Homo sapiens
  misc_feature (24)..(24): n is a, c, g, or t
  misc_feature (3004)..(3006): n is a, c, g, or t
  misc_feature (3018)..(3019): n is a, c, g, or t
  misc_feature (3025)..(3025): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731906 - DNA, 3645 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731907 - DNA, 3097 bp, Homo sapiens
  misc_feature (24)..(24): n is a, c, g, or t
  misc_feature (3059)..(3059): n is a, c, g, or t
  misc_feature (3094)..(3094): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731908 - DNA, 2968 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731909 - DNA, 2928 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731910 - DNA, 2929 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731911 - DNA, 3036 bp, Homo sapiens
  misc_feature (24)..(24): n is a, c, g, or t
  misc_feature (3005)..(3007): n is a, c, g, or t
  misc_feature (3019)..(3020): n is a, c, g, or t
  misc_feature (3026)..(3026): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731912 - DNA, 2969 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731913 - DNA, 3646 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731914 - DNA, 3098 bp, Homo sapiens
  misc_feature (24)..(24): n is a, c, g, or t
  misc_feature (3060)..(3060): n is a, c, g, or t
  misc_feature (3095)..(3095): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731915 - DNA, 2585 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccattttaaaaaaaaaaaaaaaaaaaaaaaaaaaaaaaaaaaaaaaaaaat

SEQ ID NO: 731916 - DNA, 1488 bp, Homo sapiens; identical to SEQ ID NO: 307434
  misc_feature (24)..(24): n is a, c, g, or t

SEQ ID NO: 731917 - DNA, 2168 bp, Homo sapiens; identical to SEQ ID NO: 307437
  misc_feature (24)..(24): n is a, c, g, or t

SEQ ID NO: 731918 - DNA, 2973 bp, Homo sapiens
  misc_feature (24)..(24): n is a, c, g, or t
  misc_feature (2935)..(2935): n is a, c, g, or t
  misc_feature (2970)..(2970): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731919 - DNA, 3189 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaagcggaatacagcacattaagtcaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcatcaacaaaatgtatgtctggttccccagtagagctatactgcctcaacccaaggggatattttaatgtctggggcagaaacactcaagttgattagaaagaccagccaatgtcagtgtatctgggtccttaacccacttggctagtgtgaattatagtacaatgatatttttttttgtggagataggtcagaacatagaggg

SEQ ID NO: 731920 - DNA, 2858 bp, Homo sapiens
  misc_feature (24)..(24): n is a, c, g, or t
  misc_feature (2827)..(2829): n is a, c, g, or t
  misc_feature (2841)..(2842): n is a, c, g, or t
  misc_feature (2848)..(2848): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaaaaaaaaaaaaaaaacaaacacaaaaaaacnnntggggggcgccnngggccncggaaaaacc

SEQ ID NO: 731921 - DNA, 3468 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggt

SEQ ID NO: 731922 - DNA, 2920 bp, Homo sapiens
  misc_feature (24)..(24): n is a, c, g, or t
  misc_feature (2882)..(2882): n is a, c, g, or t
  misc_feature (2917)..(2917): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataaaaaaaaaaaaaaaaaaaaaaaaaaaaaaaaaaaaaaaaaaaataaaaaaaaaaaaaaaaaaaaaaaaaaaaaaaaaaaaaaaaaaaaaanaaaaaaaaaaaaaaaaaaaaaaaaaaaaaaaaaanaag

SEQ ID NO: 731923 - DNA, 2791 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaata

SEQ ID NO: 731924 - DNA, 2751 bp, Homo sapiens
  misc_feature (24)..(24): n is a, c, g, or t
aaacagtgtatcaacgcagagtgnccattacggccgggggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacctactctggagcatttctcatcagtagttcacatacaaatcatccatccttgccaatagtgtcatcctcacagtgaacactcagtggcccatggcattttataggcatacctcctatgggttgtcaccaagctaggtgctattggtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctatcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaa

SEQ ID NO: 731925 - DNA, 2482 bp, Homo sapiens; identical to SEQ ID NO: 406823

SEQ ID NO: 731926 - DNA, 1369 bp, Homo sapiens; identical to SEQ ID NO: 406822

SEQ ID NO: 731927 - DNA, 1969 bp, Homo sapiens; identical to SEQ ID NO: 406820

SEQ ID NO: 731928 - DNA, 2313 bp, Homo sapiens; identical to SEQ ID NO: 406824

SEQ ID NO: 731929 - DNA, 516 bp, Homo sapiens
tcgtgccgaattcggcacgagctgacttctggattctcctcttgagtaaaaggactcagccaactatgaagttttttgtttttgctttaatcttggctctcatgctttccatgactggagctgattcacatgcaaagagacatcatgggtataaaagaaaattccatgaaaagcatcattcacatcgaggctatagatcaaattatctgtatgacaattgatatcttcagtaatcatggggcatgattatggaggtttgactggcaaattcgctttggactcgtgtattctcatttgtcataccgcatcacactaccactgctttttgaagaattatcataaggcaatgcagaataaaagaaataccatgatttagtgaattctgtgtttcaggatacttcccttcctaattatcatttgattagatacttgcaatttaaatgttaagctgttttcactgctgtttctgagtaatagaaattcattcctctccaaaagcaataaaattcaagcaca

SEQ ID NO: 731930 - DNA, 523 bp, Homo sapiens
catctcttgagacttcacttcagcttcactgacttctggattctcctcttgagtaaaaggactcagccaactatgaagttttttgtttttgctttaatcttggctctcatgctttccatgactggagctgattcacatgcaaagagacatcatgggtataaaagaaaattccatgaaaagcatcattcacatcgaggctatagatcaaattatctgtatgacaattgatatcttcagtaatcatggggcatgattatggaggtttgactggcaaattcgctttggactcgtgtattctcatttgtcataccgcatcacactaccactgctttttgaagaattatcataaggcaatgcagaataaaagaaataccatgatttagtgaattctgtgtttcaggatacttcccttcctaattatcatttgattagatacttgcaatttaaatgttaagctgttttcactgctgtttctgagtaatagaaattcattcctctccaaaagcaataaaattcaagcaca

SEQ ID NO: 731931 - DNA, 467 bp, Homo sapiens
aggacgcctaccaggaggacctgggactcagccaactatgaagttttttgtttttgctttaatcttggctctcatgctttccatgactagacatcatgggtataaaagaaaattccatgaaaagcatcattcacatcgaggctatagatcaaattatctgtatgacaattgatatcttcagtaatcatggggcatgattatggaggtttgactggcaaattcgctttggactcgtgtattctcatttgtcataccgcatcacactaccactgctttttgaagaattatcataaggcaatgcagaataaaagaaataccatgatttagtgaattctgtgtttcaggatacttcccttcctaattatcatttgattagatacttgcaatttaaatgttaagctgttttcactgctgtttctgagtaatagaaattcattcctctccaaaagcaataaaattcaagcaca

SEQ ID NO: 731932 - DNA, 1014 bp, Homo sapiens; identical to SEQ ID NO: 284263
  misc_feature (25)..(25): n is a, c, g, or t

SEQ ID NO: 731933 - DNA, 1134 bp, Homo sapiens; identical to SEQ ID NO: 284252
  misc_feature (25)..(25): n is a, c, g, or t

SEQ ID NO: 731934 - DNA, 1247 bp, Homo sapiens; identical to SEQ ID NO: 284254

SEQ ID NO: 731935 - DNA, 1149 bp, Homo sapiens; identical to SEQ ID NO: 284253

SEQ ID NO: 731936 - DNA, 382 bp, Homo sapiens; identical to SEQ ID NO: 284256
  misc_feature (25)..(25): n is a, c, g, or t
  misc_feature (287)..(287): n is a, c, g, or t
  misc_feature (289)..(289): n is a, c, g, or t
  misc_feature (373)..(373): n is a, c, g, or t

SEQ ID NO: 731937 - DNA, 1356 bp, Homo sapiens; identical to SEQ ID NO: 284257

SEQ ID NO: 731938 - DNA, 1083 bp, Homo sapiens; identical to SEQ ID NO: 284259

SEQ ID NO: 731939 - DNA, 959 bp, Homo sapiens; identical to SEQ ID NO: 284261

SEQ ID NO: 731940 - DNA, 972 bp, Homo sapiens; identical to SEQ ID NO: 284258

SEQ ID NO: 731941 - DNA, 969 bp, Homo sapiens; identical to SEQ ID NO: 284260
  misc_feature (25)..(25): n is a, c, g, or t

SEQ ID NO: 731942 - DNA, 690 bp, Homo sapiens; identical to SEQ ID NO: 284262

SEQ ID NO: 731943 - DNA, 2917 bp, Homo sapiens
  misc_feature (798)..(798): n is a, c, g, or t
  misc_feature (904)..(904): n is a, c, g, or t
  misc_feature (1295)..(1295): n is a, c, g, or t
  misc_feature (1510)..(1510): n is a, c, g, or t
  misc_feature (1590)..(1590): n is a, c, g, or t
  misc_feature (1655)..(1655): n is a, c, g, or t
  misc_feature (1664)..(1664): n is a, c, g, or t
  misc_feature (1668)..(1668): n is a, c, g, or t
  misc_feature (1710)..(1711): n is a, c, g, or t
  misc_feature (1717)..(1717): n is a, c, g, or t
  misc_feature (2654)..(2654): n is a, c, g, or t
  misc_feature (2912)..(2912): n is a, c, g, or t
  misc_feature (2914)..(2917): n is a, c, g, or t
ggagcctggctgctctggacctccctcctgctcctggccaggcctgcccagccctgtcccatgggttgtgactgcttcgtccaggaggtgttctgctcagatgaggagcttgccaccgtcccgctggacatcccgccatatacgaaaaacatcatctttgtggagacctcgttcaccacattggaaaccagagcttttggcagtaaccccaacttgaccaaggtggtcttcctcaacactcagctctgccagtttaggccggatgcctttggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgaccttnctgagcttgcagtggaacatgcttcgggtcctgcctgccggcctctttgcccacaccccatgcctggttggcctgtctctgacccataaccagctggagactgtcnctgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggaggcatcttcgacaccaactacaacctgttcaacctggccctgcacggtaacccctggcagtgcgactgcacctggcctacctcttcaactggctgcagcagtacaccgatcggctcctgaacatccagacctactgcgctgccctgcctacctcaaaggccaggtggtgcncgccttgaatgagaagcagctggtgtccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctcctnggcagggctccctgggactgcagtacaatgctagtcaggagtgggacctgaggcgagctgcggttctctgcggctcaccntgtctatcgaggctcgggcagcagggccctagtagcagccatacaggagctggggaagggggctntggggctgnccangcgacaggtaggggcgaggggagctgagtctccgaagcttgnntttacntgcaagggacagggttacatccccaaggtgagggggtggagtctggtctgctccactaaccagggtctcctcctcctcttccttcatcgcttctcctggagtgtgcggcctaacaaggccatccttatgccttgcaaagcaccctcaaaagctgcaccacagcctggagaataaaatatcctcagccctgatgcctccccattatgtaacacccaaccgctctcacctacaccctgaggtctattcactgcatcccagtgatacaaagtggaggccactgccttctgacatctggctcaaaagcccagtgtctgtttccatttatttccctggaatttcatttaaaattggtatagagaaaaaaaggatgtgacagaagcagagatgaccagaaagcacaggggcagggttctgactggcgtgtgggagaccctgtggccggcacccacctccacacgaggactaagctctgatttttttatcttgcccaaattcctacctaaggggtctagggagtcgcgccttacaaatcataaattctcatcagatgggttttatttgaccctgtatatcatgacttatttttaatctgactatggcataacattacaagacgaggcaaaaatatttaacccccaaatatatttccttggccctaccttgaacttggccctgcagagtctcttgtgaggagaatccacatcctataaaggaagcccctttcccctttgttttccttcctttctttccagtccaggagatcatcaactaagagccaggcaccccttttaagtcgataagaaacagtttacaacctgctctctctctctctgaagtctgctgagagcttcccctgcacaataaaacttggcctccacaatcctttatcttaacctgaacattcctttccattgatcccaggtcttcagctaagctnaaccaattgtcaaccagaaaatgtttaaatttacctacagcctggaagcacccacccccgctgcttcgagttgtcctgcctttctgaactcaaccaatgtatttcttaaatgtatttgattgatgcctcattcctccctaaaatgtataaaaccaagctgtacctcgaccaccttgggcacatgttcccaggccctcctgaggtctgtgtcacgggccatggccactcatatttggctcagaataaatctcttcaaanannnn

SEQ ID NO: 731944 - DNA, 637 bp, Homo sapiens
  misc_feature (632)..(632): n is a, c, g, or t
  misc_feature (634)..(637): n is a, c, g, or t
ggagcctggctgctctggacctccctcctgctcctggccaggcctgcccagccctgtcccatgggttgtgactgcttcgtccaggaggtgttctgctcagatgaggagcttgccaccgtcccgctggacatcccgccatatacgaaaaacatcatctttgtggagacctcgttcaccacattggaaaccagagcttttggcagtaaccccaacttgaccaaggtggtcttcctcaacactcagctctgccagtttaggccggatgcctttggggggctgcccaggctggaggacctggaggtcacaggcagtagcttcttgaacctcagcaccaacatcttctccaacctgacctcgctgggcaagctcaccctcaacaattgtcaaccagaaaatgtttaaatttacctacagcctggaagcacccacccccgctgcttcgagttgtcctgcctttctgaactcaaccaatgtatttcttaaatgtatttgattgatgcctcattcctccctaaaatgtataaaaccaagctgtacctcgaccaccttgggcacatgttcccaggccctcctgaggtctgtgtcacgggccatggccactcatatttggctcagaataaatctcttcaaanannnn

SEQ ID NO: 731945 - DNA, 884 bp, Homo sapiens
  misc_feature (881)..(881): n is a, c, g, or t
caagggacagggttacatccccaaggtgagggggtggagtctggtctgctccactaaccagggtctcctcctcctcttccttcatcgcttctcctggagtgtgcggcctaacaaggccatccttatgccttgcaaagcaccctcaaaagctgcaccacagcctggagaataaaatatcctcagccctgatgcctccccattatgtaacacccaaccgctctcacctacaccctgaggtctattcactgcatcccagtgatacaaagtggaggccactgccttctgacatctggctcaaaagcccagtgtctgtttccatttatttccctggaatttcatttaaaattggtatagagaaaatggcgtgtgggagaccctgtggccggcacccacctccacacgaggactaagctctgatttttttatcttgcccaaattcctacctaaggggtctagggagtcgcgccttacaaatcataaattctcatcagatgggttttatttgaccctgtatatcatgacttatttttaatctgactatggcataacattacaagacgaggcaaaaatatttaacccccaaatatatttccttggccctaccttgaacttggccctgcagagtctcttgtgaggagaatccacatcctataaaggaagcccctttcccctttgttttccttcctttctttccagtccaggagatcatcaactaagagccaggcaccccttttaagtcgataagaaacagtttacaacctgctctctctctctctgaagtctgctgagagcttcccctgcacaataaaacttggcctccacaatcctttatcttaacctgaacattcctttccattgatcccaggtcttcagctaagctnaac

SEQ ID NO: 731946 - DNA, 3054 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtat

SEQ ID NO: 731947 - DNA, 856 bp, Homo sapiens; identical to SEQ ID NO: 358589

SEQ ID NO: 731948 - DNA, 2972 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggattgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731949 - DNA, 1546 bp, Homo sapiens
aaaaaagttaagtgcaaagaatcaagcctggtatgttagttttcatcactgagatcagccaagatggaattagagtgcaagataatttaccggggggaccaccatgaggaaaagtggagtagaagtgggaggagcctgagagagccctcagaccacgatgcagatctgattcctgagaaggagaaagaggagagagttttagatagtgatgcagttctcagagtttccacaaggctggtggggcgtcctcaagcccctcacccatgagagagaagcagagtcccccagaactgggcttttcattcccctggtgggagcccatgagaagcgagttctctgtgcaacggacttagtaaatacagaatgcactagcctgggccttctgccaatcaagtccctgccacagagacccaacagacttatttatgcctaccacaactgagacactgagaaaaagatgcaaccatgaaaagatagaaagttctaatgacacgcaaaaatagcaatcagactttctcaaatttcaaagccttcagaaatagctgagtgcagacaggccagggtggaattgacagaagactgatcaccaactagcaacacagtgagagagaaaaaattgcaactttcccacaaaactaatgcattccttgaagcaacaagtagagactgcttcatgctgagagctggaacctggggcaccccactgtaaaataacatcacattcattccttctcttttctttccatgacggacgattcaatacattgtcaaagcctcttggtccttttttaacatctcacacttgtgtcattctctccattcccataaacctcaacaactgctcaaagtcctgcttgaccccttgttgccagtctttgaaatctttcttgcatatgactgcctcattaccttcctaaaatctagttcactcgcctactcaagaagacacaggggcctactgtggtgtattagataagttcacatttcttctctttactaatcttttttacttcctttaccaccactcccttatataattccatcatcctaatagatctgtttccctacacatccctgcctctccaccccacatgtacacagaattcttagttccggtgttacacctaaaaacatgtcaaacagggtgacctccttccactgtctgcactgtggagttacccacacccttaatcacaagcaacttctgacctcatgaagaacaaagactgtagcattaacctgtgagtcttaagctcaggacacaactgtgcctgtgactgagaaccttttcctgataaccaattcatatgttcataacagatacagaaatgaagaaggcaaggtccttaattctataacaggagacaaaacctgaaaaataatcataatgccaaaatagaaaggagtgaacatcacaagaaattagagaaatctgacggaaaatatagctacacattggaatcactcagaaacattttataaaatggatacttaagtcccaccgataaattccgatttactgatctataggagtggtgaggcattc

SEQ ID NO: 731950 - DNA, 1790 bp, Homo sapiens; identical to SEQ ID NO: 358611

SEQ ID NO: 731951 - DNA, 1308 bp, Homo sapiens
aactcctgatctgcccgcctcggcctcccaaagtgctgggattacaggcgtgagccaccgcacccggccgatttggactttttaacacaggattgggacaggattcagagggacactgtggcccttctacaatcaggagcttcccctttcctctgatgacatcacctgtggctttgttctctttgttccagatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731952 - DNA, 3687 bp, Homo sapiens
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 731953 - DNA, 3205 bp, Homo sapiens
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731954 - DNA, 3484 bp, Homo sapiens; identical to SEQ ID NO: 358585

SEQ ID NO: 731955 - DNA, 3002 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731956 - DNA, 2550 bp, Homo sapiens; identical to SEQ ID NO: 358604

SEQ ID NO: 731957 - DNA, 2753 bp, Homo sapiens
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 731958 - DNA, 852 bp, Homo sapiens; identical to SEQ ID NO: 358632

SEQ ID NO: 731959 - DNA, 3459 bp, Homo sapiens; identical to SEQ ID NO: 358601

SEQ ID NO: 731960 - DNA, 2977 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731961 - DNA, 2525 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 731962 - DNA, 3662 bp, Homo sapiens
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 731963 - DNA, 3180 bp, Homo sapiens
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731964 - DNA, 2728 bp, Homo sapiens
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 731965 - DNA, 2485 bp, Homo sapiens; identical to SEQ ID NO: 358623
  misc_feature (54)..(54): n is a, c, g, or t

SEQ ID NO: 731966 - DNA, 2003 bp, Homo sapiens
  misc_feature (54)..(54): n is a, c, g, or t
aagcagtgcatcgtctcatggtatagctgttccagtgggctcagagtcttagcncagatcaccatgcaagatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731967 - DNA, 1551 bp, Homo sapiens
  misc_feature (54)..(54): n is a, c, g, or t
aagcagtgcatcgtctcatggtatagctgttccagtgggctcagagtcttagcncagatcaccatgcaagatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 731968 - DNA, 584 bp, Homo sapiens
  misc_feature (54)..(54): n is a, c, g, or t
aagcagtgcatcgtctcatggtatagctgttccagtgggctcagagtcttagcncagatcaccatgcaagatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataacttgtccaccgggcgatcctctaatca

SEQ ID NO: 731969 - DNA, 1583 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataacttgtccaccgggcgatcctctaatca

SEQ ID NO: 731970 - DNA, 1630 bp, Homo sapiens; identical to SEQ ID NO: 358615

SEQ ID NO: 731971 - DNA, 1148 bp, Homo sapiens
tccgtctcaaaaaaaaaaaaaaaaaaagaattgcctgtggagtttttcaacatacgtaagcctatactttgttggccctgttcattaatgggctccaccaggaaattaggaatctagttgagaaacagaagctgaatggaaaggccaccttatttgatatgttaaattatatgggaagcactgtcaaatcattagtgatgttaaaccttctctaagttatatttatgagtatgttattgatgtattccaaaagttatataagaaattctagaaatctaattggttatcagccataatgtcatatgccacagaagtaactaaatttctatgtgagttgtgttcttattataataaattatcatcagatttttaactgtactcattttaaatctttgtcattcacagacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731972 - DNA, 1407 bp, Homo sapiens; identical to SEQ ID NO: 358614

SEQ ID NO: 731973 - DNA, 925 bp, Homo sapiens
ggcccgaggggcacaggagaggtagcaaaggcccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731974 - DNA, 1786 bp, Homo sapiens
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataacttgtccaccgggcgatcctctaatca

SEQ ID NO: 731975 - DNA, 3067 bp, Homo sapiens
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 731976 - DNA, 2585 bp, Homo sapiens
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731977 - DNA, 2133 bp, Homo sapiens
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 731978 - DNA, 1166 bp, Homo sapiens
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataacttgtccaccgggcgatcctctaatca

SEQ ID NO: 731979 - DNA, 3042 bp, Homo sapiens
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 731980 - DNA, 2560 bp, Homo sapiens
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731981 - DNA, 2108 bp, Homo sapiens
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 731982 - DNA, 1845 bp, Homo sapiens
  misc_feature (191)..(191): n is a, c, g, or t
gaatgataggtgcagtgagattcactcaattgagctgatcgattttataaacgtcgtcgaccttgagtcagaactctggcgtctgatcagagacaggccacccaatcacagcaggtgcttggaggggagtggaatctcagtagagttgatgactcaccaagtgcaaatgggaaaaagcaacacagtcacanttccatgtatacccggcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 731983 - DNA, 1363 bp, Homo sapiens
  misc_feature (191)..(191): n is a, c, g, or t
gaatgataggtgcagtgagattcactcaattgagctgatcgattttataaacgtcgtcgaccttgagtcagaactctggcgtctgatcagagacaggccacccaatcacagcaggtgcttggaggggagtggaatctcagtagagttgatgactcaccaagtgcaaatgggaaaaagcaacacagtcacanttccatgtatacccggcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731984 - DNA, 2619 bp, Homo sapiens
  misc_feature (191)..(191): n is a, c, g, or t
gaatgataggtgcagtgagattcactcaattgagctgatcgattttataaacgtcgtcgaccttgagtcagaactctggcgtctgatcagagacaggccacccaatcacagcaggtgcttggaggggagtggaatctcagtagagttgatgactcaccaagtgcaaatgggaaaaagcaacacagtcacanttccatgtatacccggcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 731985 - DNA, 2137 bp, Homo sapiens
  misc_feature (191)..(191): n is a, c, g, or t
gaatgataggtgcagtgagattcactcaattgagctgatcgattttataaacgtcgtcgaccttgagtcagaactctggcgtctgatcagagacaggccacccaatcacagcaggtgcttggaggggagtggaatctcagtagagttgatgactcaccaagtgcaaatgggaaaaagcaacacagtcacanttccatgtatacccggcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731986 - DNA, 1685 bp, Homo sapiens
  misc_feature (191)..(191): n is a, c, g, or t
gaatgataggtgcagtgagattcactcaattgagctgatcgattttataaacgtcgtcgaccttgagtcagaactctggcgtctgatcagagacaggccacccaatcacagcaggtgcttggaggggagtggaatctcagtagagttgatgactcaccaagtgcaaatgggaaaaagcaacacagtcacanttccatgtatacccggcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 731987 - DNA, 1248 bp, Homo sapiens
  misc_feature (191)..(191): n is a, c, g, or t
  misc_feature (1181)..(1181): n is a, c, g, or t
  misc_feature (1203)..(1203): n is a, c, g, or t
  misc_feature (1213)..(1213): n is a, c, g, or t
gaatgataggtgcagtgagattcactcaattgagctgatcgattttataaacgtcgtcgaccttgagtcagaactctggcgtctgatcagagacaggccacccaatcacagcaggtgcttggaggggagtggaatctcagtagagttgatgactcaccaagtgcaaatgggaaaaagcaacacagtcacanttccatgtatacccggcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctgatgggagcaagactgatcttctcccatcagcattttgtaaatcaatgtgaaatttgcaaacaagctaagatacattttcttgaaaattgtcctaatttttgattgtatagtttngtcttctgtgattctatctgtncaggcatatnagcataaatttttcatatcgatcacaacatatcac

SEQ ID NO: 731988 - DNA, 718 bp, Homo sapiens
  misc_feature (191)..(191): n is a, c, g, or t
gaatgataggtgcagtgagattcactcaattgagctgatcgattttataaacgtcgtcgaccttgagtcagaactctggcgtctgatcagagacaggccacccaatcacagcaggtgcttggaggggagtggaatctcagtagagttgatgactcaccaagtgcaaatgggaaaaagcaacacagtcacanttccatgtatacccggcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataacttgtccaccgggcgatcctctaatca

SEQ ID NO: 731989 - DNA, 1678 bp, Homo sapiens
  misc_feature (31)..(31): n is a, c, g, or t
  misc_feature (34)..(34): n is a, c, g, or t
ttagaggatcccattggaccaggcagacgancantctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 731990 - DNA, 1196 bp, Homo sapiens
  misc_feature (31)..(31): n is a, c, g, or t
  misc_feature (34)..(34): n is a, c, g, or t
ttagaggatcccattggaccaggcagacgancantctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731991 - DNA, 2452 bp, Homo sapiens
  misc_feature (31)..(31): n is a, c, g, or t
  misc_feature (34)..(34): n is a, c, g, or t
ttagaggatcccattggaccaggcagacgancantctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 731992 - DNA, 1970 bp, Homo sapiens
  misc_feature (31)..(31): n is a, c, g, or t
  misc_feature (34)..(34): n is a, c, g, or t
ttagaggatcccattggaccaggcagacgancantctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731993 - DNA, 1518 bp, Homo sapiens
  misc_feature (31)..(31): n is a, c, g, or t
  misc_feature (34)..(34): n is a, c, g, or t
ttagaggatcccattggaccaggcagacgancantctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 731994 - DNA, 1081 bp, Homo sapiens
  misc_feature (31)..(31): n is a, c, g, or t
  misc_feature (34)..(34): n is a, c, g, or t
  misc_feature (1014)..(1014): n is a, c, g, or t
  misc_feature (1036)..(1036): n is a, c, g, or t
  misc_feature (1046)..(1046): n is a, c, g, or t
ttagaggatcccattggaccaggcagacgancantctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctgatgggagcaagactgatcttctcccatcagcattttgtaaatcaatgtgaaatttgcaaacaagctaagatacattttcttgaaaattgtcctaatttttgattgtatagtttngtcttctgtgattctatctgtncaggcatatnagcataaatttttcatatcgatcacaacatatcac

SEQ ID NO: 731995 - DNA, 551 bp, Homo sapiens
  misc_feature (31)..(31): n is a, c, g, or t
  misc_feature (34)..(34): n is a, c, g, or t
ttagaggatcccattggaccaggcagacgancantctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataacttgtccaccgggcgatcctctaatca

SEQ ID NO: 731996 - DNA, 1711 bp, Homo sapiens
  misc_feature (54)..(54): n is a, c, g, or t
aagcagtgcatcgtctcatggtatagctgttccagtgggctcagagtcttagcncagatcaccatgcaagatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 731997 - DNA, 1229 bp, Homo sapiens
  misc_feature (54)..(54): n is a, c, g, or t
aagcagtgcatcgtctcatggtatagctgttccagtgggctcagagtcttagcncagatcaccatgcaagatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 731998 - DNA, 1114 bp, Homo sapiens
  misc_feature (54)..(54): n is a, c, g, or t
  misc_feature (1047)..(1047): n is a, c, g, or t
  misc_feature (1069)..(1069): n is a, c, g, or t
  misc_feature (1079)..(1079): n is a, c, g, or t
aagcagtgcatcgtctcatggtatagctgttccagtgggctcagagtcttagcncagatcaccatgcaagatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctgatgggagcaagactgatcttctcccatcagcattttgtaaatcaatgtgaaatttgcaaacaagctaagatacattttcttgaaaattgtcctaatttttgattgtatagtttngtcttctgtgattctatctgtncaggcatatnagcataaatttttcatatcgatcacaacatatcac

SEQ ID NO: 731999 - DNA, 747 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcagga

SEQ ID NO: 732000 - DNA, 2710 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732001 - DNA, 2228 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732002 - DNA, 2113 bp, Homo sapiens; identical to SEQ ID NO: 358606
  misc_feature (2046)..(2046): n is a, c, g, or t
  misc_feature (2068)..(2068): n is a, c, g, or t
  misc_feature (2078)..(2078): n is a, c, g, or t

SEQ ID NO: 732003 - DNA, 2088 bp, Homo sapiens
  misc_feature (2021)..(2021): n is a, c, g, or t
  misc_feature (2043)..(2043): n is a, c, g, or t
  misc_feature (2053)..(2053): n is a, c, g, or t
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctgatgggagcaagactgatcttctcccatcagcattttgtaaatcaatgtgaaatttgcaaacaagctaagatacattttcttgaaaattgtcctaatttttgattgtatagtttngtcttctgtgattctatctgtncaggcatatnagcataaatttttcatatcgatcacaacatatcac

SEQ ID NO: 732004 - DNA, 2183 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732005 - DNA, 1701 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732006 - DNA, 2957 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732007 - DNA, 2475 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732008 - DNA, 2023 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 732009 - DNA, 1586 bp, Homo sapiens
  misc_feature (1519)..(1519): n is a, c, g, or t
  misc_feature (1541)..(1541): n is a, c, g, or t
  misc_feature (1551)..(1551): n is a, c, g, or t
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctgatgggagcaagactgatcttctcccatcagcattttgtaaatcaatgtgaaatttgcaaacaagctaagatacattttcttgaaaattgtcctaatttttgattgtatagtttngtcttctgtgattctatctgtncaggcatatnagcataaatttttcatatcgatcacaacatatcac

SEQ ID NO: 732010 - DNA, 1056 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataacttgtccaccgggcgatcctctaatca

SEQ ID NO: 732011 - DNA, 1747 bp, Homo sapiens; identical to SEQ ID NO: 358610

SEQ ID NO: 732012 - DNA, 1265 bp, Homo sapiens
tggtgattagaggatcccccgctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732013 - DNA, 2913 bp, Homo sapiens
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732014 - DNA, 2431 bp, Homo sapiens
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732015 - DNA, 2316 bp, Homo sapiens
  misc_feature (2249)..(2249): n is a, c, g, or t
  misc_feature (2271)..(2271): n is a, c, g, or t
  misc_feature (2281)..(2281): n is a, c, g, or t
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctgatgggagcaagactgatcttctcccatcagcattttgtaaatcaatgtgaaatttgcaaacaagctaagatacattttcttgaaaattgtcctaatttttgattgtatagtttngtcttctgtgattctatctgtncaggcatatnagcataaatttttcatatcgatcacaacatatcac

SEQ ID NO: 732016 - DNA, 2291 bp, Homo sapiens
  misc_feature (2224)..(2224): n is a, c, g, or t
  misc_feature (2246)..(2246): n is a, c, g, or t
  misc_feature (2256)..(2256): n is a, c, g, or t
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctgatgggagcaagactgatcttctcccatcagcattttgtaaatcaatgtgaaatttgcaaacaagctaagatacattttcttgaaaattgtcctaatttttgattgtatagtttngtcttctgtgattctatctgtncaggcatatnagcataaatttttcatatcgatcacaacatatcac

SEQ ID NO: 732017 - DNA, 2293 bp, Homo sapiens
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732018 - DNA, 1811 bp, Homo sapiens
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732019 - DNA, 1696 bp, Homo sapiens
  misc_feature (1629)..(1629): n is a, c, g, or t
  misc_feature (1651)..(1651): n is a, c, g, or t
  misc_feature (1661)..(1661): n is a, c, g, or t
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctgatgggagcaagactgatcttctcccatcagcattttgtaaatcaatgtgaaatttgcaaacaagctaagatacattttcttgaaaattgtcctaatttttgattgtatagtttngtcttctgtgattctatctgtncaggcatatnagcataaatttttcatatcgatcacaacatatcac

SEQ ID NO: 732020 - DNA, 1671 bp, Homo sapiens
  misc_feature (1604)..(1604): n is a, c, g, or t
  misc_feature (1626)..(1626): n is a, c, g, or t
  misc_feature (1636)..(1636): n is a, c, g, or t
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctgatgggagcaagactgatcttctcccatcagcattttgtaaatcaatgtgaaatttgcaaacaagctaagatacattttcttgaaaattgtcctaatttttgattgtatagtttngtcttctgtgattctatctgtncaggcatatnagcataaatttttcatatcgatcacaacatatcac

SEQ ID NO: 732021 - DNA, 2564 bp, Homo sapiens
  misc_feature (191)..(191): n is a, c, g, or t
gaatgataggtgcagtgagattcactcaattgagctgatcgattttataaacgtcgtcgaccttgagtcagaactctggcgtctgatcagagacaggccacccaatcacagcaggtgcttggaggggagtggaatctcagtagagttgatgactcaccaagtgcaaatgggaaaaagcaacacagtcacanttccatgtatacccggcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732022 - DNA, 2082 bp, Homo sapiens
  misc_feature (191)..(191): n is a, c, g, or t
gaatgataggtgcagtgagattcactcaattgagctgatcgattttataaacgtcgtcgaccttgagtcagaactctggcgtctgatcagagacaggccacccaatcacagcaggtgcttggaggggagtggaatctcagtagagttgatgactcaccaagtgcaaatgggaaaaagcaacacagtcacanttccatgtatacccggcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732023 - DNA, 2397 bp, Homo sapiens
  misc_feature (31)..(31): n is a, c, g, or t
  misc_feature (34)..(34): n is a, c, g, or t
ttagaggatcccattggaccaggcagacgancantctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732024 - DNA, 1915 bp, Homo sapiens
  misc_feature (31)..(31): n is a, c, g, or t
  misc_feature (34)..(34): n is a, c, g, or t
ttagaggatcccattggaccaggcagacgancantctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732025 - DNA, 416 bp, Homo sapiens
  misc_feature (31)..(31): n is a, c, g, or t
  misc_feature (34)..(34): n is a, c, g, or t
ttagaggatcccattggaccaggcagacgancantctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctcccgagtaactgggattacacacacgtgcc

SEQ ID NO: 732026 - DNA, 2430 bp, Homo sapiens
  misc_feature (54)..(54): n is a, c, g, or t
aagcagtgcatcgtctcatggtatagctgttccagtgggctcagagtcttagcncagatcaccatgcaagatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732027 - DNA, 1948 bp, Homo sapiens
  misc_feature (54)..(54): n is a, c, g, or t
aagcagtgcatcgtctcatggtatagctgttccagtgggctcagagtcttagcncagatcaccatgcaagatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732028 - DNA, 1932 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732029 - DNA, 1450 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732030 - DNA, 2706 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732031 - DNA, 2224 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732032 - DNA, 2651 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732033 - DNA, 2169 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732034 - DNA, 1772 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 732035 - DNA, 1335 bp, Homo sapiens
  misc_feature (12)..(12): n is a, c, g, or t
  misc_feature (24)..(24): n is a, c, g, or t
  misc_feature (1268)..(1268): n is a, c, g, or t
  misc_feature (1290)..(1290): n is a, c, g, or t
  misc_feature (1300)..(1300): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctgatgggagcaagactgatcttctcccatcagcattttgtaaatcaatgtgaaatttgcaaacaagctaagatacattttcttgaaaattgtcctaatttttgattgtatagtttngtcttctgtgattctatctgtncaggcatatnagcataaatttttcatatcgatcacaacatatcac

SEQ ID NO: 732036 - DNA, 805 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataacttgtccaccgggcgatcctctaatca

SEQ ID NO: 732037 - DNA, 670 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctcccgagtaactgggattacacacacgtgcc

SEQ ID NO: 732038 - DNA, 2681 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732039 - DNA, 2199 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732040 - DNA, 2626 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732041 - DNA, 2144 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732042 - DNA, 1747 bp, Homo sapiens
  misc_feature (12)..(12): n is a, c, g, or t
  misc_feature (24)..(24): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 732043 - DNA, 1310 bp, Homo sapiens
  misc_feature (12)..(12): n is a, c, g, or t
  misc_feature (24)..(24): n is a, c, g, or t
  misc_feature (1243)..(1243): n is a, c, g, or t
  misc_feature (1265)..(1265): n is a, c, g, or t
  misc_feature (1275)..(1275): n is a, c, g, or t
tgacccagtcancctgaatgtccnctatggcccagacgagcccatccattaccacctctcatatcgcctgattagcgtccaggggatgaacctcacctctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctgatgggagcaagactgatcttctcccatcagcattttgtaaatcaatgtgaaatttgcaaacaagctaagatacattttcttgaaaattgtcctaatttttgattgtatagtttngtcttctgtgattctatctgtncaggcatatnagcataaatttttcatatcgatcacaacatatcac

SEQ ID NO: 732044 - DNA, 3429 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 732045 - DNA, 2947 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaa

SEQ ID NO: 732046 - DNA, 6140 bp, Homo sapiens; identical to SEQ ID NO: 355084

SEQ ID NO: 732047 - DNA, 880 bp, Homo sapiens
gcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgagatttgaacactgcttgctttgttagactgtgttcagtaagtgaatcccagtagcctgaagcaatgtgttagcagaatctatttgtaacattattattgtacagtagaatcaatattaaacacacatgttttattatatggagtcattatttttaatatgaaatttaatttgcagagtcctgaacctatataatgggtttattttaaatgtgattgtacttgcagaatatctaattaattgctaggttaataactaaagaagccattaaataaatcaaaattgtaacatgttttagat

SEQ ID NO: 732048 - DNA, 997 bp, Homo sapiens
ctgtgtctgtaaactgatggctaacaaaactaggattttggtcacttctaaaatggaacatttaaagaaagctgacaaaatattaattttgaatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcag

SEQ ID NO: 732049 - DNA, 1991 bp, Homo sapiens
gttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttcttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgtgaaaaaaaaaag

SEQ ID NO: 732050 - DNA, 467 bp, Homo sapiens; identical to SEQ ID NO: 355087

SEQ ID NO: 732051 - DNA, 411 bp, Homo sapiens
aaaatgttgttatttttatttcagatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgagatttgaacactgcttgctttgttagactgtgttcagtaagtgaatcccagtagcctgaagcaatgtgttagcagaatctatttgtaacattattattgtacagtagaatcaatattaaacacacatgttttat

SEQ ID NO: 732052 - DNA, 935 bp, Homo sapiens; identical to SEQ ID NO: 54800

SEQ ID NO: 732053 - DNA, 366 bp, Homo sapiens; identical to SEQ ID NO: 54797

SEQ ID NO: 732054 - DNA, 435 bp, Homo sapiens
gaggttggactgtggtgcaggaaagcctcaagtagaggagggttgaggcttcagtccagcacctttctcgggtcacggcctcctcctggctcccaggaccccaccataggcagaggcaggccttcctacaccctactccctgtgcctccagcctcgactagtccctagcactcgacgactgagtctctgaggtcacttcaccgtggtctccgcctcacccttggcgctggaccagtgagaggagagggctggggcgctccgctgagccactcctgcgcccccctggccttgtctacctcttgccccccgagggtttagtgtcgagctcaccccagcatcctatcaacctcctggtggccttgccgcccccacaaccccgaggtataaagccaggtacacgaggcaggggacacaccaaggatggagatgttccag

SEQ ID NO: 732055 - DNA, 870 bp, Homo sapiens; identical to SEQ ID NO: 54798

SEQ ID NO: 732056 - DNA, 246 bp, Homo sapiens; identical to SEQ ID NO: 54799

SEQ ID NO: 732057 - DNA, 2424 bp, Homo sapiens
  misc_feature (642)..(642): n is a, c, g, or t
  misc_feature (2420)..(2424): n is a, c, g, or t
accttctgtatcagttaagtgtcaagatggaaggaacagcagtctcaagataatgcaaagagtttattcatcacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggncttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctgnnnnn

SEQ ID NO: 732058 - DNA, 3006 bp, Homo sapiens
  misc_feature (1224)..(1224): n is a, c, g, or t
  misc_feature (3002)..(3006): n is a, c, g, or t
ctcaattggaggatcaaagttgagaaaagtaatattcgacatttttcgattcaacggagtggccaccaagacgatgtcatagaagtctgaacgagtctcagttccaatttggtagaccacttcatacatctttgttggatttcctgtgtacttggtctttgttttctcctcgatgtacattactgagccagatataagattgcttttggatgcctgcagaagccctgagcaaacaagtttattgccaccttctactgcccaaaggccagaatcagaacaggacagtgacaccgcccccacaaaggcattgatgtccgtgctttggccataattgaccctcataacaggagcaatcatttcattgaggaacttctcagaaaagccggccttttgcaaggtttcaagaagtgttcgattaagcattccaaggaagtcatctcctcctagagcatgaagtaatttttcgacactactgaaggcatagtcatgagactggtagcggtagatcctcatgaacttgtctaacacgtcctctacccacatgtgcatacggagggattgaaatccatagcgccaaactaatttaatcacgttaattatgaaccagttgctctcctcaaataccagagtctctccattatatatccccagtacacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggncttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctgnnnnn

SEQ ID NO: 732059 - DNA, 1559 bp, Homo sapiens
ggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctta

SEQ ID NO: 732060 - DNA, 872 bp, Homo sapiens
  misc_feature (709)..(709): n is a, c, g, or t
  misc_feature (714)..(714): n is a, c, g, or t
  misc_feature (717)..(717): n is a, c, g, or t
  misc_feature (722)..(722): n is a, c, g, or t
  misc_feature (725)..(725): n is a, c, g, or t
ggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggccggatggccnagccnggntctgncangaccagagtctgggtggggccggggatcccgggcctcccgggaggggcctggggttcccgttggggggcaatggggtctaaggccccctttggcccggtggccctccctcgggggggggtttgccacccgtcccctcttcggggtct

SEQ ID NO: 732061 - DNA, 522 bp, Homo sapiens
ggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagcccaaccaggagctctagttaatggagagctcccagcacactcggagcttgtgctttgtctccacgcaaagcgataaataaaagcattggtggcctta

SEQ ID NO: 732062 - DNA, 1461 bp, Homo sapiens
ggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccac

SEQ ID NO: 732063 - DNA, 742 bp, Homo sapiens
cctccattaggcgcgttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctta

SEQ ID NO: 732064 - DNA, 644 bp, Homo sapiens
cctccattaggcgcgttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccac

SEQ ID NO: 732065 - DNA, 599 bp, Homo sapiens
ggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagcaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctta

SEQ ID NO: 732066 - DNA, 1205 bp, Homo sapiens
ggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctta

SEQ ID NO: 732067 - DNA, 1107 bp, Homo sapiens
ggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccac

SEQ ID NO: 732068 - DNA, 1081 bp, Homo sapiens
ggggggtcagtgtcacctccaggatacagacagccccccttcagcccagcccagccaggtctcctacaccgccaccatgccattcggtaacacccacaacaattcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctta

SEQ ID NO: 732069 - DNA, 983 bp, Homo sapiens
ggggggtcagtgtcacctccaggatacagacagccccccttcagcccagcccagccaggtctcctacaccgccaccatgccattcggtaacacccacaacaattcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccac

SEQ ID NO: 732070 - DNA, 1531 bp, Homo sapiens
ggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctta

SEQ ID NO: 732071 - DNA, 1433 bp, Homo sapiens
ggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccac

SEQ ID NO: 732072 - DNA, 199 bp, Homo sapiens; identical to SEQ ID NO: 346077

SEQ ID NO: 732073 - DNA, 1677 bp, Homo sapiens
ggcctcacggtcctgctgatatgtgacatcacccccggaggcccagctgtaaattcctctctttgtactctttctctttatttctcagaccagccgacacttagggaaaatagaacctacgctgaaattttgggggcaggttctcttgctaggttttgaggttttgctgaagatattcctgaagaatcatcccaggtgccacactaaaaaaatgatccagttgacagctacccctgtgagtgcacttgttgatgagccagtgcatatccaagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccaggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaac

SEQ ID NO: 732074 - DNA, 2186 bp, Homo sapiens
ggcctcacggtcctgctgatatgtgacatcacccccggaggcccagctgtaaattcctctctttgtactctttctctttatttctcagacgcagctgcacaggaacatgcttggaaggagatccagagatttctcaggaagcacctcattccagatgtgaccagtcaactctaagaagactagatattcctagaaaataaagaagcaaatctctttaccaggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatcccataaataaaaaatactttagtttgctaaccaactgaatatatgaggactgcatgtaattcaaccacatggttgtttgctgtacagtcctttgcaaatattaaaaattttttttgctataaggctttgatcatatagtcctcatagcaacataactaccatctagcatgtaccacattttgcaagactttaagttcaacattccaaactgccaatttgtattatgtccaaatgcagtatccttgaggaatatagtgggtcagttaaatatctagagacatacaaacatctgctaattcatctcattgagatggatcattctgatctccatcatccacccacttttcatcagcttctcctacttcattctcctcatagtctttatcatgagggattctgtatcctgtctctcatctacacttgctggccttcctggttgtgatttattggaacagtctacacaaaaaccatagggtcaagatccatgtcttactccaacactggctgctaacatgatcttacataccatacatttgcatttttatccttcttgtgcaccaagaaatgttttcttacatgttttctccaagtgtaaaaagtcacagctaaatgatctcactcctgtatgaataagcaagtgcttttttagtgtttgtttgcatttggctgcatagctacaatgatggcattttaacttattcatgattagagatgatgatatggtttggatatttgttgtgcccaaatttcatgctgaaatgtaatccctagtgttggaggtgaggcctggtgggagttgtttgggtcatgggggtggaccctcatggcttggtactgtcctcatgagagtatgatagtgagtgagttctcaagagatatgactgtttaaaagtgtgtggcacctcctccccatcctcacactctttcttgcctcctctctcgccatgtgagatgcctcctcgctgttcacctgctgccatgattgtaaacttcctgaggcctccccagaagccaagtagatgcaagcattatgcttctgtaaagcctgcaggaccatgatccaattaaatctcttttctttataaattaac

SEQ ID NO: 732075 - DNA, 3426 bp, Homo sapiens; identical to SEQ ID NO: 413981

SEQ ID NO: 732076 - DNA, 3480 bp, Homo sapiens; identical to SEQ ID NO: 413978

SEQ ID NO: 732077 - DNA, 3101 bp, Homo sapiens; identical to SEQ ID NO: 413980

SEQ ID NO: 732078 - DNA, 3047 bp, Homo sapiens; identical to SEQ ID NO: 413982

SEQ ID NO: 732079 - DNA, 539 bp, Homo sapiens; identical to SEQ ID NO: 315284

SEQ ID NO: 732080 - DNA, 416 bp, Homo sapiens; identical to SEQ ID NO: 315290

SEQ ID NO: 732081 - DNA, 712 bp, Homo sapiens
  misc_feature (544)..(546): n is a, c, g, or t
ctgtctcccgccacccacaccagctgtcccactcaccatggagaagatcctgatcctcctgcttgtcgccctctctgtggcctatgcagctcctggcccccgggggatcattatcaacctggagaacggtgagctctgcatgaatagtgcccagtgtaagagcaattgctgccagcattcaagtgcgctgggcctggcccgctgcacatccatggccagcgagaacagcgagtgctctgtcaagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaaccttaaaannnaaaaaaaaggaaaagcccacaggccccccaaccaaaaaagctattttttgagttgcccctgtttgaatggaataaggattgaagggatatgagggggttttttttgggggggggctcggtccccaaaatccccattttggaggtcttattcccccctttattgggg

SEQ ID NO: 732082 - DNA, 2439 bp, Homo sapiens
ccacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggagctgctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcgcgcgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtgtgtgccgttggctgggccggcaacgggatcctctgtggtcgcgacactgacctagacggcttcccggacgagaagctgcgctgcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcaggga

SEQ ID NO: 732083 - DNA, 1613 bp, Homo sapiens
  misc_feature (11)..(11): n is a, c, g, or t
  misc_feature (17)..(17): n is a, c, g, or t
  misc_feature (28)..(28): n is a, c, g, or t
  misc_feature (30)..(30): n is a, c, g, or t
gcggtaccggncctganttcccgggtcnanccacgcgtccggcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcaggga

SEQ ID NO: 732084 - DNA, 1014 bp, Homo sapiens
  misc_feature (11)..(11): n is a, c, g, or t
  misc_feature (17)..(17): n is a, c, g, or t
  misc_feature (28)..(28): n is a, c, g, or t
  misc_feature (30)..(30): n is a, c, g, or t
gcggtaccggncctganttcccgggtcnanccacgcgtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcaggga

SEQ ID NO: 732085 - DNA, 672 bp, Homo sapiens
ttaattcattctacaaatatttattaaagcccaactgtgtgccagccaccaggcatagaatagggaacaaaatagtttccctgcaactatataaaaagaatggcatattgtacttaaatgcctccttgccaaaataagaggcacaggacaacagctgtctggagatgacctcaagccagtcaggccccattttaaatatagaaacccctaagaatagccgccagtgctccagactcaacaggtgattggcccagagaggggaggtgaccccaggccccaggaaagggagcgaggacagcgctggttcccggctccccgcaccatcatggctttgcctctgaggcccctgacccggggcttggccagcgctgccaaaggaggccacggaggagcaggagctcgtacctggcgtctgctgaccttcgtgctggcgctgcccagcgtggccctctgcaccttcaactcctatctccactcgggccaccgcccgcgccccgagttccgtccctaccaacacctccgcatccgcaccaagccctacccctggggggacggcaaccacactctgttccacaatagccacgtgaaccctctgcccacgggctacgaacacccctgaggccccggacgcccccggacacaataaaggtgtgaagcttcgaaaaaaaaaaa

SEQ ID NO: 732086 - DNA, 774 bp, Homo sapiens
ttaattcattctacaaatatttattaaagcccaactgtgtgccagccaccaggcatagaatagggaacaaaatagtttccctgcaactatataaaaagaatggcatattgtacttaaatgcctccttgccaaaataagaggcacaggacaacagctgtctggagatgacctcaagccagtcaggccccattttaaatatagaaacccctaagaatagccgccagtgctccagactcaacaggtgattggcccagagaggggaggtgaccccaggccccaggaaagggagcgaggacagcgctggttcccggctccccgcaccatcatggctttgcctctgaggcccctgacccggggcttggccagcgctgccaaaggaggccacggaggagcaggaggtgagtggggaacgggcggatccgggggctcccctaccctgcccacctgttcacaggcccgccgccccaggaccgccgcgctcaccccgctccgaacgcaacctcgtacctggcgtctgctgaccttcgtgctggcgctgcccagcgtggccctctgcaccttcaactcctatctccactcgggccaccgcccgcgccccgagttccgtccctaccaacacctccgcatccgcaccaagccctacccctggggggacggcaaccacactctgttccacaatagccacgtgaaccctctgcccacgggctacgaacacccctgaggccccggacgcccccggacacaataaaggtgtgaagcttcgaaaaaaaaaaa

SEQ ID NO: 732087 - DNA, 771 bp, Homo sapiens
gcgagcggcccgcaggggctggtgtcactggtcattcctgcacaggacagtccaccatggcctcagatcaccagacccaggcgggcaagccacagtccctcaaccccaagatcatcatctttgagcaggaaaactttcaaggccactcgcatgagctcaatgggccctgccccaacctgaaggaaactggcgtggagaaggcaggttctgtcctagtgcaggctggaccctgggtgggctatgaacaggccaactgcaagggcgagcagtttgtgtttgagaagggtgagtacccccgctgggactcatggaccagcagccgaaggacggactccctcagctccctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgcgggtgcagagtggcacgtgggttggctaccagtaccccggctaccgtgggctgcagtacctgctggagaagggagactacaaggacagcagcgactttggggcccctcacccccaggtgcagtccgtgcgccgtatccgcgacatgcagtggcaccaacgtggtgccttccacccctccaactagtgccctccccaccatgcctccttcccaggacccaggtctgctgcccaggaaccctccagacctcccagagagtgaataaagtgtgacttgcaacttg

SEQ ID NO: 732088 - DNA, 821 bp, Homo sapiens
caccggcacttctggggaaggtataaatgccacctcccgctggccgagcttcacggcactcgcaggggctggtgtcactggtcattcctgcacaggacagtccaccatggcctcagatcaccagacccaggcgggcaagccacagtccctcaaccccaagatcatcatctttgagcaggaaaactttcaaggccactcgcatgagctcaatgggccctgccccaacctgaaggaaactggcgtggagaaggcaggttctgtcctagtgcaggctggaccctgggtgggctatgaacaggccaactgcaagggcgagcagtttgtgtttgagaagggtgagtacccccgctgggactcatggaccagcagccgaaggacggactccctcagctccctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgcgggtgcagagtggcacgtgggttggctaccagtaccccggctaccgtgggctgcagtacctgctggagaagggagactacaaggacagcagcgactttggggcccctcacccccaggtgcagtccgtgcgccgtatccgcgacatgcagtggcaccaacgtggtgccttccacccctccaactagtgccctccccaccatgcctccttcccaggacccaggtctgctgcccaggaaccctccagacctcccagagagtgaataaagtgtgacttgcaacttg

SEQ ID NO: 732089 - DNA, 649 bp, Homo sapiens
ggcacgaggaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctc

SEQ ID NO: 732090 - DNA, 1114 bp, Homo sapiens
ggcacgaggaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaag

SEQ ID NO: 732091 - DNA, 1741 bp, Homo sapiens; identical to SEQ ID NO: 55424

SEQ ID NO: 732092 - DNA, 997 bp, Homo sapiens
tatgcctatgccctggccaacttcattcagtcccagggcatcagctccctgaaggtgtggaccagtcacatgaagaggaccatccagacagctgaggccctgggtgtcccctatgagcagtggaaggccctgaatgagattgatgcgggtgtctgtgaggagatgacctatgaagaaatccaggaacattaccctgaagaatttgcactgcgagaccaagataaatatcgctaccgctatcccaagggagagtcctatgaggatctggttcagcgtctggagccagtgataatggagctagaacgacaggagaatgtactggtgatctgccaccaggctgtcatgcggtgcctcctggcctatttcctggataaaagttcaggtactaccctcatctctgctttgggaatgtttgatggtatttgagacactgacaccaacaattagatatctatatcttagtagttaagagaagagtatctagaacaaggatgcctaggttcagattctttctctttcacatactagctgtactgcctttcacaaatttctttaacttctctggcctcagtgtcctcatctgtaaaatggggagaataatgatgaattttaaataacataagtaaaaagtttagaacagttcatgacacattgtgtgggctatatattaactgctattattagtatagtattattcttagctaacattttcaaagccaacgttaacagtctgcctcaatctggaaaagatgagctagtatttctgtgaagcatgctaccatcaggtgatagtagggcctttcatagcttcatgatcctgattacaagtttctgtccttgctataggggtaatttccccaagatagtgatgttttcattttaaattgtttttcaaatgataatttatttttaaaaaaatatgtaggcattgcatttacagagtatttacacactgactgcataggctgaactgcaaactggggcagctggcctggca

SEQ ID NO: 732093 - DNA, 1505 bp, Homo sapiens; identical to SEQ ID NO: 381845

SEQ ID NO: 732094 - DNA, 1284 bp, Homo sapiens
gcaaaggccaaggccagccaggacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccaggtgaaccggccactgaccatgcggaaggatggtattcagactcgaaaccgcaaggcatctggaaaagggaaaaagaaacggggctccagtctgggaggcacaggagcagccgaaggaccacactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctgaaaaaat

SEQ ID NO: 732095 - DNA, 1109 bp, Homo sapiens
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatgggggtgagggtggcaccagggatccccaatcctggggccccactggcttccagggactggggagagaaacactgctgccctctttttagcagtcaggcgctgacccaagagaactcaccgtattcttcatttcccctcgtgaatcctccaggcctttctctacaacctggaggggagggaggaaaatggatgaatgagagagggagggaacagtgcccaagcgcttggcctctccttctcttccttcactttgcagaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732096 - DNA, 775 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732097 - DNA, 856 bp, Homo sapiens
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732098 - DNA, 700 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732099 - DNA, 1099 bp, Homo sapiens
  misc_feature (900)..(900): n is a, c, g, or t
  misc_feature (902)..(902): n is a, c, g, or t
  misc_feature (918)..(918): n is a, c, g, or t
  misc_feature (927)..(927): n is a, c, g, or t
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaccaaaaaaaaaaaagagagtcgtattacaattacttggccgcgntntacaacgtcgtgactngggcctggnggtcccaacttaatcgcttggcagccatccccctttcgcagatgtcgtaaagcgaagagggccgcaacgatcgccttcccaacaatgcgcaactgcatggcacatgcaaatgtaccggtgaccttgggtcacatcggtaaattgttaaatagtccatttaccaggcgactgc

SEQ ID NO: 732100 - DNA, 1018 bp, Homo sapiens
  misc_feature (819)..(819): n is a, c, g, or t
  misc_feature (821)..(821): n is a, c, g, or t
  misc_feature (837)..(837): n is a, c, g, or t
  misc_feature (846)..(846): n is a, c, g, or t
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaccaaaaaaaaaaaagagagtcgtattacaattacttggccgcgntntacaacgtcgtgactngggcctggnggtcccaacttaatcgcttggcagccatccccctttcgcagatgtcgtaaagcgaagagggccgcaacgatcgccttcccaacaatgcgcaactgcatggcacatgcaaatgtaccggtgaccttgggtcacatcggtaaattgttaaatagtccatttaccaggcgactgc

SEQ ID NO: 732101 - DNA, 943 bp, Homo sapiens
  misc_feature (744)..(744): n is a, c, g, or t
  misc_feature (746)..(746): n is a, c, g, or t
  misc_feature (762)..(762): n is a, c, g, or t
  misc_feature (771)..(771): n is a, c, g, or t
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaccaaaaaaaaaaaagagagtcgtattacaattacttggccgcgntntacaacgtcgtgactngggcctggnggtcccaacttaatcgcttggcagccatccccctttcgcagatgtcgtaaagcgaagagggccgcaacgatcgccttcccaacaatgcgcaactgcatggcacatgcaaatgtaccggtgaccttgggtcacatcggtaaattgttaaatagtccatttaccaggcgactgc

SEQ ID NO: 732102 - DNA, 881 bp, Homo sapiens
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732103 - DNA, 800 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732104 - DNA, 725 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732105 - DNA, 1030 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagttttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732106 - DNA, 1273 bp, Homo sapiens
  misc_feature (1074)..(1074): n is a, c, g, or t
  misc_feature (1076)..(1076): n is a, c, g, or t
  misc_feature (1092)..(1092): n is a, c, g, or t
  misc_feature (1101)..(1101): n is a, c, g, or t
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagttttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaccaaaaaaaaaaaagagagtcgtattacaattacttggccgcgntntacaacgtcgtgactngggcctggnggtcccaacttaatcgcttggcagccatccccctttcgcagatgtcgtaaagcgaagagggccgcaacgatcgccttcccaacaatgcgcaactgcatggcacatgcaaatgtaccggtgaccttgggtcacatcggtaaattgttaaatagtccatttaccaggcgactgc

SEQ ID NO: 732107 - DNA, 1055 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagttttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732108 - DNA, 1073 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732109 - DNA, 1316 bp, Homo sapiens
  misc_feature (1117)..(1117): n is a, c, g, or t
  misc_feature (1119)..(1119): n is a, c, g, or t
  misc_feature (1135)..(1135): n is a, c, g, or t
  misc_feature (1144)..(1144): n is a, c, g, or t
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaccaaaaaaaaaaaagagagtcgtattacaattacttggccgcgntntacaacgtcgtgactngggcctggnggtcccaacttaatcgcttggcagccatccccctttcgcagatgtcgtaaagcgaagagggccgcaacgatcgccttcccaacaatgcgcaactgcatggcacatgcaaatgtaccggtgaccttgggtcacatcggtaaattgttaaatagtccatttaccaggcgactgc

SEQ ID NO: 732110 - DNA, 1098 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732111 - DNA, 1283 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagttttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732112 - DNA, 1526 bp, Homo sapiens
  misc_feature (1327)..(1327): n is a, c, g, or t
  misc_feature (1329)..(1329): n is a, c, g, or t
  misc_feature (1345)..(1345): n is a, c, g, or t
  misc_feature (1354)..(1354): n is a, c, g, or t
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagttttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaccaaaaaaaaaaaagagagtcgtattacaattacttggccgcgntntacaacgtcgtgactngggcctggnggtcccaacttaatcgcttggcagccatccccctttcgcagatgtcgtaaagcgaagagggccgcaacgatcgccttcccaacaatgcgcaactgcatggcacatgcaaatgtaccggtgaccttgggtcacatcggtaaattgttaaatagtccatttaccaggcgactgc

SEQ ID NO: 732113 - DNA, 1308 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagttttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732114 - DNA, 1028 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732115 - DNA, 953 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732116 - DNA, 1196 bp, Homo sapiens
  misc_feature (997)..(997): n is a, c, g, or t
  misc_feature (999)..(999): n is a, c, g, or t
  misc_feature (1015)..(1015): n is a, c, g, or t
  misc_feature (1024)..(1024): n is a, c, g, or t
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaccaaaaaaaaaaaagagagtcgtattacaattacttggccgcgntntacaacgtcgtgactngggcctggnggtcccaacttaatcgcttggcagccatccccctttcgcagatgtcgtaaagcgaagagggccgcaacgatcgccttcccaacaatgcgcaactgcatggcacatgcaaatgtaccggtgaccttgggtcacatcggtaaattgttaaatagtccatttaccaggcgactgc

SEQ ID NO: 732117 - DNA, 978 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732118 - DNA, 1271 bp, Homo sapiens
  misc_feature (1072)..(1072): n is a, c, g, or t
  misc_feature (1074)..(1074): n is a, c, g, or t
  misc_feature (1090)..(1090): n is a, c, g, or t
  misc_feature (1099)..(1099): n is a, c, g, or t
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaccaaaaaaaaaaaagagagtcgtattacaattacttggccgcgntntacaacgtcgtgactngggcctggnggtcccaacttaatcgcttggcagccatccccctttcgcagatgtcgtaaagcgaagagggccgcaacgatcgccttcccaacaatgcgcaactgcatggcacatgcaaatgtaccggtgaccttgggtcacatcggtaaattgttaaatagtccatttaccaggcgactgc

SEQ ID NO: 732119 - DNA, 1053 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732120 - DNA, 887 bp, Homo sapiens
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaattccagtgtgcctgtatgagtggtgtgt

SEQ ID NO: 732121 - DNA, 721 bp, Homo sapiens
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732122 - DNA, 974 bp, Homo sapiens
  misc_feature (807)..(807): n is a, c, g, or t
  misc_feature (810)..(810): n is a, c, g, or t
  misc_feature (812)..(812): n is a, c, g, or t
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctgggccancancnggcctataaatcagtggctccaacacccacaaaacccgggggggcgcacccataccaaggacctaaaaccgagccgacaaaacggcgggaccgcgtgcacaaacggtcgaacccgcgcgagacagcgcgccaccagacgcagaggcacggggcaccacgcac

SEQ ID NO: 732123 - DNA, 806 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaattccagtgtgcctgtatgagtggtgtgt

SEQ ID NO: 732124 - DNA, 731 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaattccagtgtgcctgtatgagtggtgtgt

SEQ ID NO: 732125 - DNA, 1061 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagttttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaattccagtgtgcctgtatgagtggtgtgt

SEQ ID NO: 732126 - DNA, 963 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732127 - DNA, 1104 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaattccagtgtgcctgtatgagtggtgtgt

SEQ ID NO: 732128 - DNA, 1191 bp, Homo sapiens
  misc_feature (1024)..(1024): n is a, c, g, or t
  misc_feature (1027)..(1027): n is a, c, g, or t
  misc_feature (1029)..(1029): n is a, c, g, or t
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctgggccancancnggcctataaatcagtggctccaacacccacaaaacccgggggggcgcacccataccaaggacctaaaaccgagccgacaaaacggcgggaccgcgtgcacaaacggtcgaacccgcgcgagacagcgcgccaccagacgcagaggcacggggcaccacgcac

SEQ ID NO: 732129 - DNA, 1314 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagttttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaattccagtgtgcctgtatgagtggtgtgt

SEQ ID NO: 732130 - DNA, 938 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732131 - DNA, 984 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaattccagtgtgcctgtatgagtggtgtgt

SEQ ID NO: 732132 - DNA, 1059 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaattccagtgtgcctgtatgagtggtgtgt

SEQ ID NO: 732133 - DNA, 374 bp, Homo sapiens
gatcccaaggcccaactccccgaaccactcagggtcctgtggacagctcacctagctgcaatggctacagaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732134 - DNA, 746 bp, Homo sapiens
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732135 - DNA, 831 bp, Homo sapiens
  misc_feature (808)..(808): n is a, c, g, or t
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggatcagngcacagctgtctataaatagtgc

SEQ ID NO: 732136 - DNA, 851 bp, Homo sapiens
  misc_feature (828)..(828): n is a, c, g, or t
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctgggggttcctggcggaagatgcatcagngcacagctgtctataaatagtgc

SEQ ID NO: 732137 - DNA, 779 bp, Homo sapiens
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctcaagttgccactccagtgcccaccagccttgtcctaataaaattaagttgcatca

SEQ ID NO: 732138 - DNA, 760 bp, Homo sapiens
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732139 - DNA, 785 bp, Homo sapiens
cgtcgacacggctgcgagagacgacagaaggggaaggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732140 - DNA, 535 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732141 - DNA, 623 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctcaagttgccactccagtgcccaccagccttgtcctaataaaattaagttgcatca

SEQ ID NO: 732142 - DNA, 698 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctcaagttgccactccagtgcccaccagccttgtcctaataaaattaagttgcatca

SEQ ID NO: 732143 - DNA, 732 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttcctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732144 - DNA, 655 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttcctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctcaagttgccactccagtgcccaccagccttgtcctaataaaattaagttgcatca

SEQ ID NO: 732145 - DNA, 763 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttcctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaattccagtgtgcctgtatgagtggtgtgt

SEQ ID NO: 732146 - DNA, 975 bp, Homo sapiens
  misc_feature (776)..(776): n is a, c, g, or t
  misc_feature (778)..(778): n is a, c, g, or t
  misc_feature (794)..(794): n is a, c, g, or t
  misc_feature (803)..(803): n is a, c, g, or t
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttcctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaccaaaaaaaaaaaagagagtcgtattacaattacttggccgcgntntacaacgtcgtgactngggcctggnggtcccaacttaatcgcttggcagccatccccctttcgcagatgtcgtaaagcgaagagggccgcaacgatcgccttcccaacaatgcgcaactgcatggcacatgcaaatgtaccggtgaccttgggtcacatcggtaaattgttaaatagtccatttaccaggcgactgc

SEQ ID NO: 732147 - DNA, 757 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttcctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732148 - DNA, 953 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagttttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctcaagttgccactccagtgcccaccagccttgtcctaataaaattaagttgcatca

SEQ ID NO: 732149 - DNA, 679 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732150 - DNA, 704 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732151 - DNA, 604 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732152 - DNA, 629 bp, Homo sapiens
gatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732153 - DNA, 996 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctcaagttgccactccagtgcccaccagccttgtcctaataaaattaagttgcatca

SEQ ID NO: 732154 - DNA, 1048 bp, Homo sapiens
  misc_feature (1025)..(1025): n is a, c, g, or t
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggatcagngcacagctgtctataaatagtgc

SEQ ID NO: 732155 - DNA, 1068 bp, Homo sapiens
  misc_feature (1045)..(1045): n is a, c, g, or t
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctgggggttcctggcggaagatgcatcagngcacagctgtctataaatagtgc

SEQ ID NO: 732156 - DNA, 1206 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagttttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctcaagttgccactccagtgcccaccagccttgtcctaataaaattaagttgcatca

SEQ ID NO: 732157 - DNA, 876 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctcaagttgccactccagtgcccaccagccttgtcctaataaaattaagttgcatca

SEQ ID NO: 732158 - DNA, 951 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctcaagttgccactccagtgcccaccagccttgtcctaataaaattaagttgcatca

SEQ ID NO: 732159 - DNA, 977 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732160 - DNA, 1002 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732161 - DNA, 932 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732162 - DNA, 957 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtctgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732163 - DNA, 985 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttcctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 732164 - DNA, 908 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttcctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctcaagttgccactccagtgcccaccagccttgtcctaataaaattaagttgcatca

SEQ ID NO: 732165 - DNA, 1016 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttcctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaattccagtgtgcctgtatgagtggtgtgt

SEQ ID NO: 732166 - DNA, 1228 bp, Homo sapiens
  misc_feature (1029)..(1029): n is a, c, g, or t
  misc_feature (1031)..(1031): n is a, c, g, or t
  misc_feature (1047)..(1047): n is a, c, g, or t
  misc_feature (1056)..(1056): n is a, c, g, or t
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttcctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaccaaaaaaaaaaaagagagtcgtattacaattacttggccgcgntntacaacgtcgtgactngggcctggnggtcccaacttaatcgcttggcagccatccccctttcgcagatgtcgtaaagcgaagagggccgcaacgatcgccttcccaacaatgcgcaactgcatggcacatgcaaatgtaccggtgaccttgggtcacatcggtaaattgttaaatagtccatttaccaggcgactgc

SEQ ID NO: 732167 - DNA, 1010 bp, Homo sapiens
gatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaccagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttcctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcaaaaaaaaaaaaaaaaaaaaaaaaaa

SEQ ID NO: 732168 - DNA, 645 bp, Homo sapiens; identical to SEQ ID NO: 62061

SEQ ID NO: 732169 - DNA, 3880 bp, Homo sapiens
cgagacactgggaccacagcggcagctccgctgaaaactgcattcagccagtcctccggacttctggagcggggacagggcgcagggcatcagcagccaccagcaggacctgggaaatagggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacacgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcggcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaggaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaa

SEQ ID NO: 732170 - DNA, 993 bp, Homo sapiens
gaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcggcaaggatgcgatatttcgccaaggttggttactcacctgcttcaactttgtgcatttcaggtctcaagtggacattcatggtgtttatggattcaccctaaagaagttaccagctgccgacttcctgtccaagcagtttaagactcttgaaggacatcctcttagcttcggcataagtctgtgaaatatttgaacaatgttctttgaatgttgctcatctatttctctggtgaaattatacacaccatgaagaggctataaaatgcataaggttcctatcattccatgccttcttggaggggtaccgtgtttttgctgcatattctcattttacagtcatctgtgtgttgatccacagacctgtatatgggaaaatgggcaacattatttattaactgcaaagtaacaccttgttagataaaacttcgttggcacaca

SEQ ID NO: 732171 - DNA, 531 bp, Homo sapiens
acatcatgagtggataaacttttatgagtatttgtaaatttcttgaaattgctttcttatgggattcatgtcataaactatttgggcattacaattatgaaagtattccagaaatcagaagttttgacctgtgtgtatgttattaaatttagctactctgtactccttgcccaaaatgtttaatgatttccagtttcattaactagtagatacattgaaaaatataaaattaaatattcccctataagtcaatatttgcataatactgctaacttgtttttttattaggtcattcatttcactttacaaatccatttcatacttgttattagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcagg

SEQ ID NO: 732172 - DNA, 369 bp, Homo sapiens; identical to SEQ ID NO: 62063

SEQ ID NO: 732173 - DNA, 692 bp, Homo sapiens; identical to SEQ ID NO: 62064

SEQ ID NO: 732174 - DNA, 7724 bp, Homo sapiens
  misc_feature (7233)..(7235): n is a, c, g, or t
  misc_feature (7294)..(7294): n is a, c, g, or t
  misc_feature (7308)..(7309): n is a, c, g, or t
  misc_feature (7485)..(7486): n is a, c, g, or t
  misc_feature (7546)..(7546): n is a, c, g, or t
gccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcggagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccacccagttcggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgagctttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgtgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgcgggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcggcccccagatgctgacctcccaggctccgtgtgtagatggcttcgaggagccaggagcacggcagcgggccctcagcgcagtcagcgtcctcacaagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctaatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcaccggcctcagaagcccgcagcccttgccgcccagggccagctgcccagctgcattgccaccccctactccccgccacccccagagacggagaaggtgcctcccacccgcaaggaaacacagtttgaggaaggcgagcaaccaggccagggcacccccggggatccagagcccgtgtgtgtgcccatcgctgtggccgagtcagacacagatgaccaagaagaggatgaggagaacagcctgggcacggaggaggagtccagcaagcagcaggaatcccagcctgtgtccggctggcccagaggccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgacgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcggccccgcggatcaaccaggcagagttctgtggcgccgcgtggacagccggagcagttggcctgtgcttggaggcctcagatagacctgtgacctggtctggtcaggcaatgcccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacacagtcctcacacacggaggccagacacaggccgtgggacccaggctcccagcctaagggagacaggcctttccctgccggccccccaaggatggggttcttgtccacggggctcactctggccccctattgtctcccaaggtcccattttcccccttgtgttttcacgcaggtcatattgtcagtcctacaaaaataaaaggcttccagaggagagtggcctggggtcccagggctgggccctaggcactgatagttgccttttcttcccctcctgtaagagtattaacaaaaccaaaggacacaagggtgcaagccccattcacggcctggcatgcagcttgtccttgctcctggaacctggcaggccctgccagccagccaatggaagagaggggctgagccatgggggtttggggctaagaagttcaccagccctgagccatggnnnccctcagcctgcctgaagagaggaaactggcgatctcccagggctctctggaccatacncggaggagttttcnngtgtggtctccagctcctctccagacacagagacatgggagtggggagcggacgttggccctggccctgtgcagggaaagggatggtcaggcccagttctcgtgccccttagaggggaatgaaccatggcacctttgagagagggggcactgtggtcaggcccagcctctctggcnnagtcccgggatcctgatggcacccacacagaggacctctttggggcaagatccaggtggntcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagagcaggccagggggcttggct

SEQ ID NO: 732175 - DNA, 1381 bp, Homo sapiens
  misc_feature (888)..(888): n is a, c, g, or t
gccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcggagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccacccagttcggagagcggctgtgaagattctggttcactcatatcctttgcagttaatacctgctgagtaccccctgggggcccacgctggggatgtgcacgtgctgcccccgacccacctccattctagtttaggagtgagagtagcgctgattccctgctggtcctaagacaaatgcatggtcatgacctgggagctggttggaaatgaagaacctctgaccctcctccagacctgccaagtcagcacctgcattttcatttgatccccaggggattcttgggcacatgaaagtttgagaaaccctcttctgattcttcagaacattctagaagctaagctactgaggatcccagaagaaatgacgtctgtcgggctctgatantggtccaaatattccgtgccccgacagacgtcccttgggtccggcgtactccagagcatagcaggaacctgctaggaggtcatcagaagctggtccaggaacaacatttcccaataaaggaggcgtaggtcatcgcaaatgcacgatgcagacacagcccggggcagcagaacggggcggaaaacaagttcggacaggccatggtcaatacgagtctgagccaagtgcttagcagaaagtgggagattggcgggtcccaaatagaagggagttgagtgggaaaccgtcacttcattgctcgaacaaaaggagcaacggactaacgaaggattagtcgacagatcacgggcgaggtgacaacacggtccagtagatgaacacagctagctatctcacaacacatcgacttgaacagactactatcaagtatatacaactacacgtacacatgtcgtctcacagctgttcttacctataccataccaccaacgag

SEQ ID NO: 732176 - DNA, 538 bp, Homo sapiens
tcttgagacttcacttcagcttcactgacttcttgactctcctcttgagtaaaaggactcagccaactatgaagttttttgtctttgctttagtcttggctctcatgatttccatgattagcgctgattcacatgaaaagagacatcatgggtatagaagaaaattccatgaaaagcatcattcacatcgagaatttccattttatggggactatggatcaaattatctatatgacaattgatatccttagtaatcatggggcatgattatagaggtttgactggcaaattcactttttactcatttattctcattcatcataccgcatcacactaccactgctttttgaagaattatcataaggcaatggagaataaaagaaagaccatgatttagtgaattctgtgtttcatgatacttcccttcctaattatcatttgattagatacttgcaatttaaactgttaagctgttttcactgctgtttctgagtaatagaaattcattcctctccaaaagcaataaatttctagcaca

SEQ ID NO: 732177 - DNA, 427 bp, Homo sapiens; identical to SEQ ID NO: 448076

SEQ ID NO: 732178 - DNA, 811 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccataaaaaaaaaaccacaacaaaaacttttggcccccttgggccccggaaaagtttcaaaacattcgttggggcggggcgcaaggggaacgggaaccgggcaaagcggtccaaggaaacccgtgcgccagagaaaagagcggagagatttcccaccatgtaaaaaaagcccggggggaacaccggcgcgttctggaacacactccgagagggccctcagaggcacaaaacgggacgcatccagagggtgccagaggaaaccgcaataaaaccg

SEQ ID NO: 732179 - DNA, 798 bp, Homo sapiens
  misc_feature (714)..(714): n is a, c, g, or t
  misc_feature (724)..(724): n is a, c, g, or t
  misc_feature (727)..(727): n is a, c, g, or t
  misc_feature (738)..(738): n is a, c, g, or t
  misc_feature (743)..(743): n is a, c, g, or t
  misc_feature (749)..(750): n is a, c, g, or t
  misc_feature (752)..(752): n is a, c, g, or t
  misc_feature (767)..(767): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaacccttttgggcggccttgggccctggaaaagtttttaaaacccttcggttggggcgcgcggcccccttgggttcggtgaacatgggccaaagcgcggtccccaggaaacaccgggcgcacgaccagggccgggnattcctcccnatnaaaaacgcccnggggncacacnnangttctggaaaaatcncgaaggagtccggggccacacgcggaccagc

SEQ ID NO: 732180 - DNA, 674 bp, Homo sapiens
  misc_feature (590)..(590): n is a, c, g, or t
  misc_feature (600)..(600): n is a, c, g, or t
  misc_feature (603)..(603): n is a, c, g, or t
  misc_feature (614)..(614): n is a, c, g, or t
  misc_feature (619)..(619): n is a, c, g, or t
  misc_feature (625)..(626): n is a, c, g, or t
  misc_feature (628)..(628): n is a, c, g, or t
  misc_feature (643)..(643): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaggaacaaaaaacaaaaaaaaaacctttttggggccgcgtgggccccttggaagaaacttttttcataaaaaccacctttcgtttgtgtagcgccgggggccccatagagtgatataggtcgaccacgtggtcaacacagatggtgttccctaaggagaaactgggggacaagtacacaatgcgcctgggnattcctcccnatnaaaaacgcccnggggncacacnnangttctggaaaaatcncgaaggagtccggggccacacgcggaccagc

SEQ ID NO: 732181 - DNA, 513 bp, Homo sapiens
gaattcttcagagatgtaagaataggatactatcagagaacaagatagaccttggaatttaaaaacaaaaatgggaaaacaaattcaataaatggatgataaagtcaaggaaatctttcaaaaagcgagtgtgtgtgtatgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcaggtcagtctttgagttgggtaggagcatgcatccctggcactgccacatcccactctgactctctcgggtctgcattctttctttgagaacacacagttccccattcttatcctgacctctgggctttcaggactgccaagaacattggggatcctgccagaaatgaggggagc

SEQ ID NO: 732182 - DNA, 1460 bp, Homo sapiens
gaattcttcagagatgtaagaataggatactatcagagaacaagatagaccttggaatttaaaaacaaaaatgggaaaacaaattcaataaatggatgataaagtcaaggaaatctttcaaaaagcgagtgtgtgtgtatgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccc

SEQ ID NO: 732183 - DNA, 2135 bp, Homo sapiens
  misc_feature (2039)..(2039): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732184 - DNA, 2198 bp, Homo sapiens
  misc_feature (2198)..(2198): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732185 - DNA, 2162 bp, Homo sapiens
  misc_feature (2066)..(2066): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732186 - DNA, 2225 bp, Homo sapiens
  misc_feature (2225)..(2225): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732187 - DNA, 2251 bp, Homo sapiens
  misc_feature (2167)..(2167): n is a, c, g, or t
  misc_feature (2177)..(2177): n is a, c, g, or t
  misc_feature (2180)..(2180): n is a, c, g, or t
  misc_feature (2191)..(2191): n is a, c, g, or t
  misc_feature (2196)..(2196): n is a, c, g, or t
  misc_feature (2202)..(2203): n is a, c, g, or t
  misc_feature (2205)..(2205): n is a, c, g, or t
  misc_feature (2220)..(2220): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaacccttttgggcggccttgggccctggaaaagtttttaaaacccttcggttggggcgcgcggcccccttgggttcggtgaacatgggccaaagcgcggtccccaggaaacaccgggcgcacgaccagggccgggnattcctcccnatnaaaaacgcccnggggncacacnnangttctggaaaaatcncgaaggagtccggggccacacgcggaccagc

SEQ ID NO: 732188 - DNA, 2150 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccagtaacaaaaacaaacgaaaaaacacaaaaaagggtgagacgccgggcaccagaaagattctaaacacaccgggggcacgggcccaagagaaggcacacgggcaagaggtgcccaggaaccggacgacaagaggggtccacaaaaag

SEQ ID NO: 732189 - DNA, 2155 bp, Homo sapiens
  misc_feature (2006)..(2006): n is a, c, g, or t
  misc_feature (2059)..(2059): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732190 - DNA, 2218 bp, Homo sapiens
  misc_feature (2006)..(2006): n is a, c, g, or t
  misc_feature (2218)..(2218): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732191 - DNA, 2175 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaccccatagaacaacaccaacacaacacaatcataaccaaacaactcacacccccacaacaaacaaaaactaattcaacctcactcacaaaaataccacaaaacaaagaaaacagacacaaaaaaaaaccacaagacacacagacctataatgcacaaaaacacaaaagag

SEQ ID NO: 732192 - DNA, 2186 bp, Homo sapiens
  misc_feature (2015)..(2015): n is a, c, g, or t
  misc_feature (2186)..(2186): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaanaagagaaaaaagacacacaacacgtggtggcacggcatcaggagcccgaggaaagcgtggcgagaaacatggagatgggagacgcgcgggcaccggaggtatagaggacacacgggcgacagaggagggccctaggaaaaccggggagagaacaagggccgggaattccan

SEQ ID NO: 732193 - DNA, 2275 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccataaaaaaaaaaccacaacaaaaacttttggcccccttgggccccggaaaagtttcaaaacattcgttggggcggggcgcaaggggaacgggaaccgggcaaagcggtccaaggaaacccgtgcgccagagaaaagagcggagagatttcccaccatgtaaaaaaagcccggggggaacaccggcgcgttctggaacacactccgagagggccctcagaggcacaaaacgggacgcatccagagggtgccagaggaaaccgcaataaaaccg

SEQ ID NO: 732194 - DNA, 2287 bp, Homo sapiens
  misc_feature (2203)..(2203): n is a, c, g, or t
  misc_feature (2213)..(2213): n is a, c, g, or t
  misc_feature (2216)..(2216): n is a, c, g, or t
  misc_feature (2227)..(2227): n is a, c, g, or t
  misc_feature (2232)..(2232): n is a, c, g, or t
  misc_feature (2238)..(2239): n is a, c, g, or t
  misc_feature (2241)..(2241): n is a, c, g, or t
  misc_feature (2256)..(2256): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaggaacaaaaaacaaaaaaaaaacctttttggggccgcgtgggccccttggaagaaacttttttcataaaaaccacctttcgtttgtgtagcgccgggggccccatagagtgatataggtcgaccacgtggtcaacacagatggtgttccctaaggagaaactgggggacaagtacacaatgcgcctgggnattcctcccnatnaaaaacgcccnggggncacacnnangttctggaaaaatcncgaaggagtccggggccacacgcggaccagc

SEQ ID NO: 732195 - DNA, 2071 bp, Homo sapiens
  misc_feature (1975)..(1975): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732196 - DNA, 2134 bp, Homo sapiens
  misc_feature (2134)..(2134): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732197 - DNA, 2098 bp, Homo sapiens
  misc_feature (2002)..(2002): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732198 - DNA, 2161 bp, Homo sapiens
  misc_feature (2161)..(2161): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732199 - DNA, 2187 bp, Homo sapiens
  misc_feature (2103)..(2103): n is a, c, g, or t
  misc_feature (2113)..(2113): n is a, c, g, or t
  misc_feature (2116)..(2116): n is a, c, g, or t
  misc_feature (2127)..(2127): n is a, c, g, or t
  misc_feature (2132)..(2132): n is a, c, g, or t
  misc_feature (2138)..(2139): n is a, c, g, or t
  misc_feature (2141)..(2141): n is a, c, g, or t
  misc_feature (2156)..(2156): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaacccttttgggcggccttgggccctggaaaagtttttaaaacccttcggttggggcgcgcggcccccttgggttcggtgaacatgggccaaagcgcggtccccaggaaacaccgggcgcacgaccagggccgggnattcctcccnatnaaaaacgcccnggggncacacnnangttctggaaaaatcncgaaggagtccggggccacacgcggaccagc

SEQ ID NO: 732200 - DNA, 2086 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccagtaacaaaaacaaacgaaaaaacacaaaaaagggtgagacgccgggcaccagaaagattctaaacacaccgggggcacgggcccaagagaaggcacacgggcaagaggtgcccaggaaccggacgacaagaggggtccacaaaaag

SEQ ID NO: 732201 - DNA, 2091 bp, Homo sapiens
  misc_feature (1942)..(1942): n is a, c, g, or t
  misc_feature (1995)..(1995): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732202 - DNA, 2154 bp, Homo sapiens
  misc_feature (1942)..(1942): n is a, c, g, or t
  misc_feature (2154)..(2154): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732203 - DNA, 2111 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaccccatagaacaacaccaacacaacacaatcataaccaaacaactcacacccccacaacaaacaaaaactaattcaacctcactcacaaaaataccacaaaacaaagaaaacagacacaaaaaaaaaccacaagacacacagacctataatgcacaaaaacacaaaagag

SEQ ID NO: 732204 - DNA, 2122 bp, Homo sapiens
  misc_feature (1951)..(1951): n is a, c, g, or t
  misc_feature (2122)..(2122): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaanaagagaaaaaagacacacaacacgtggtggcacggcatcaggagcccgaggaaagcgtggcgagaaacatggagatgggagacgcgcgggcaccggaggtatagaggacacacgggcgacagaggagggccctaggaaaaccggggagagaacaagggccgggaattccan

SEQ ID NO: 732205 - DNA, 2211 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccataaaaaaaaaaccacaacaaaaacttttggcccccttgggccccggaaaagtttcaaaacattcgttggggcggggcgcaaggggaacgggaaccgggcaaagcggtccaaggaaacccgtgcgccagagaaaagagcggagagatttcccaccatgtaaaaaaagcccggggggaacaccggcgcgttctggaacacactccgagagggccctcagaggcacaaaacgggacgcatccagagggtgccagaggaaaccgcaataaaaccg

SEQ ID NO: 732206 - DNA, 2223 bp, Homo sapiens
  misc_feature (2139)..(2139): n is a, c, g, or t
  misc_feature (2149)..(2149): n is a, c, g, or t
  misc_feature (2152)..(2152): n is a, c, g, or t
  misc_feature (2163)..(2163): n is a, c, g, or t
  misc_feature (2168)..(2168): n is a, c, g, or t
  misc_feature (2174)..(2175): n is a, c, g, or t
  misc_feature (2177)..(2177): n is a, c, g, or t
  misc_feature (2192)..(2192): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaggaacaaaaaacaaaaaaaaaacctttttggggccgcgtgggccccttggaagaaacttttttcataaaaaccacctttcgtttgtgtagcgccgggggccccatagagtgatataggtcgaccacgtggtcaacacagatggtgttccctaaggagaaactgggggacaagtacacaatgcgcctgggnattcctcccnatnaaaaacgcccnggggncacacnnangttctggaaaaatcncgaaggagtccggggccacacgcggaccagc

SEQ ID NO: 732207 - DNA, 2081 bp, Homo sapiens
  misc_feature (1985)..(1985): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732208 - DNA, 2144 bp, Homo sapiens
  misc_feature (2144)..(2144): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732209 - DNA, 2108 bp, Homo sapiens
  misc_feature (2012)..(2012): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732210 - DNA, 2171 bp, Homo sapiens
  misc_feature (2171)..(2171): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732211 - DNA, 2197 bp, Homo sapiens
  misc_feature (2113)..(2113): n is a, c, g, or t
  misc_feature (2123)..(2123): n is a, c, g, or t
  misc_feature (2126)..(2126): n is a, c, g, or t
  misc_feature (2137)..(2137): n is a, c, g, or t
  misc_feature (2142)..(2142): n is a, c, g, or t
  misc_feature (2148)..(2149): n is a, c, g, or t
  misc_feature (2151)..(2151): n is a, c, g, or t
  misc_feature (2166)..(2166): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaacccttttgggcggccttgggccctggaaaagtttttaaaacccttcggttggggcgcgcggcccccttgggttcggtgaacatgggccaaagcgcggtccccaggaaacaccgggcgcacgaccagggccgggnattcctcccnatnaaaaacgcccnggggncacacnnangttctggaaaaatcncgaaggagtccggggccacacgcggaccagc

SEQ ID NO: 732212 - DNA, 2096 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccagtaacaaaaacaaacgaaaaaacacaaaaaagggtgagacgccgggcaccagaaagattctaaacacaccgggggcacgggcccaagagaaggcacacgggcaagaggtgcccaggaaccggacgacaagaggggtccacaaaaag

SEQ ID NO: 732213 - DNA, 2101 bp, Homo sapiens
  misc_feature (1952)..(1952): n is a, c, g, or t
  misc_feature (2005)..(2005): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732214 - DNA, 2164 bp, Homo sapiens
  misc_feature (1952)..(1952): n is a, c, g, or t
  misc_feature (2164)..(2164): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732215 - DNA, 2121 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaccccatagaacaacaccaacacaacacaatcataaccaaacaactcacacccccacaacaaacaaaaactaattcaacctcactcacaaaaataccacaaaacaaagaaaacagacacaaaaaaaaaccacaagacacacagacctataatgcacaaaaacacaaaagag

SEQ ID NO: 732216 - DNA, 2132 bp, Homo sapiens
  misc_feature (1961)..(1961): n is a, c, g, or t
  misc_feature (2132)..(2132): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaanaagagaaaaaagacacacaacacgtggtggcacggcatcaggagcccgaggaaagcgtggcgagaaacatggagatgggagacgcgcgggcaccggaggtatagaggacacacgggcgacagaggagggccctaggaaaaccggggagagaacaagggccgggaattccan

SEQ ID NO: 732217 - DNA, 2221 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccataaaaaaaaaaccacaacaaaaacttttggcccccttgggccccggaaaagtttcaaaacattcgttggggcggggcgcaaggggaacgggaaccgggcaaagcggtccaaggaaacccgtgcgccagagaaaagagcggagagatttcccaccatgtaaaaaaagcccggggggaacaccggcgcgttctggaacacactccgagagggccctcagaggcacaaaacgggacgcatccagagggtgccagaggaaaccgcaataaaaccg

SEQ ID NO: 732218 - DNA, 2233 bp, Homo sapiens
  misc_feature (2149)..(2149): n is a, c, g, or t
  misc_feature (2159)..(2159): n is a, c, g, or t
  misc_feature (2162)..(2162): n is a, c, g, or t
  misc_feature (2173)..(2173): n is a, c, g, or t
  misc_feature (2178)..(2178): n is a, c, g, or t
  misc_feature (2184)..(2185): n is a, c, g, or t
  misc_feature (2187)..(2187): n is a, c, g, or t
  misc_feature (2202)..(2202): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaggaacaaaaaacaaaaaaaaaacctttttggggccgcgtgggccccttggaagaaacttttttcataaaaaccacctttcgtttgtgtagcgccgggggccccatagagtgatataggtcgaccacgtggtcaacacagatggtgttccctaaggagaaactgggggacaagtacacaatgcgcctgggnattcctcccnatnaaaaacgcccnggggncacacnnangttctggaaaaatcncgaaggagtccggggccacacgcggaccagc

SEQ ID NO: 732219 - DNA, 2017 bp, Homo sapiens
  misc_feature (1921)..(1921): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732220 - DNA, 2080 bp, Homo sapiens
  misc_feature (2080)..(2080): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732221 - DNA, 2044 bp, Homo sapiens
  misc_feature (1948)..(1948): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732222 - DNA, 2107 bp, Homo sapiens
  misc_feature (2107)..(2107): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732223 - DNA, 2133 bp, Homo sapiens
  misc_feature (2049)..(2049): n is a, c, g, or t
  misc_feature (2059)..(2059): n is a, c, g, or t
  misc_feature (2062)..(2062): n is a, c, g, or t
  misc_feature (2073)..(2073): n is a, c, g, or t
  misc_feature (2078)..(2078): n is a, c, g, or t
  misc_feature (2084)..(2085): n is a, c, g, or t
  misc_feature (2087)..(2087): n is a, c, g, or t
  misc_feature (2102)..(2102): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaacccttttgggcggccttgggccctggaaaagtttttaaaacccttcggttggggcgcgcggcccccttgggttcggtgaacatgggccaaagcgcggtccccaggaaacaccgggcgcacgaccagggccgggnattcctcccnatnaaaaacgcccnggggncacacnnangttctggaaaaatcncgaaggagtccggggccacacgcggaccagc

SEQ ID NO: 732224 - DNA, 2032 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccagtaacaaaaacaaacgaaaaaacacaaaaaagggtgagacgccgggcaccagaaagattctaaacacaccgggggcacgggcccaagagaaggcacacgggcaagaggtgcccaggaaccggacgacaagaggggtccacaaaaag

SEQ ID NO: 732225 - DNA, 2037 bp, Homo sapiens
  misc_feature (1888)..(1888): n is a, c, g, or t
  misc_feature (1941)..(1941): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732226 - DNA, 2100 bp, Homo sapiens
  misc_feature (1888)..(1888): n is a, c, g, or t
  misc_feature (2100)..(2100): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732227 - DNA, 2057 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaccccatagaacaacaccaacacaacacaatcataaccaaacaactcacacccccacaacaaacaaaaactaattcaacctcactcacaaaaataccacaaaacaaagaaaacagacacaaaaaaaaaccacaagacacacagacctataatgcacaaaaacacaaaagag

SEQ ID NO: 732228 - DNA, 2068 bp, Homo sapiens
  misc_feature (1897)..(1897): n is a, c, g, or t
  misc_feature (2068)..(2068): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaanaagagaaaaaagacacacaacacgtggtggcacggcatcaggagcccgaggaaagcgtggcgagaaacatggagatgggagacgcgcgggcaccggaggtatagaggacacacgggcgacagaggagggccctaggaaaaccggggagagaacaagggccgggaattccan

SEQ ID NO: 732229 - DNA, 2157 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccataaaaaaaaaaccacaacaaaaacttttggcccccttgggccccggaaaagtttcaaaacattcgttggggcggggcgcaaggggaacgggaaccgggcaaagcggtccaaggaaacccgtgcgccagagaaaagagcggagagatttcccaccatgtaaaaaaagcccggggggaacaccggcgcgttctggaacacactccgagagggccctcagaggcacaaaacgggacgcatccagagggtgccagaggaaaccgcaataaaaccg

SEQ ID NO: 732230 - DNA, 2169 bp, Homo sapiens
  misc_feature (2085)..(2085): n is a, c, g, or t
  misc_feature (2095)..(2095): n is a, c, g, or t
  misc_feature (2098)..(2098): n is a, c, g, or t
  misc_feature (2109)..(2109): n is a, c, g, or t
  misc_feature (2114)..(2114): n is a, c, g, or t
  misc_feature (2120)..(2121): n is a, c, g, or t
  misc_feature (2123)..(2123): n is a, c, g, or t
  misc_feature (2138)..(2138): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaggaacaaaaaacaaaaaaaaaacctttttggggccgcgtgggccccttggaagaaacttttttcataaaaaccacctttcgtttgtgtagcgccgggggccccatagagtgatataggtcgaccacgtggtcaacacagatggtgttccctaaggagaaactgggggacaagtacacaatgcgcctgggnattcctcccnatnaaaaacgcccnggggncacacnnangttctggaaaaatcncgaaggagtccggggccacacgcggaccagc

SEQ ID NO: 732231 - DNA, 2086 bp, Homo sapiens
  misc_feature (1990)..(1990): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732232 - DNA, 2149 bp, Homo sapiens
  misc_feature (2149)..(2149): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732233 - DNA, 2113 bp, Homo sapiens
  misc_feature (2017)..(2017): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732234 - DNA, 2176 bp, Homo sapiens
  misc_feature (2176)..(2176): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732235 - DNA, 2202 bp, Homo sapiens
  misc_feature (2118)..(2118): n is a, c, g, or t
  misc_feature (2128)..(2128): n is a, c, g, or t
  misc_feature (2131)..(2131): n is a, c, g, or t
  misc_feature (2142)..(2142): n is a, c, g, or t
  misc_feature (2147)..(2147): n is a, c, g, or t
  misc_feature (2153)..(2154): n is a, c, g, or t
  misc_feature (2156)..(2156): n is a, c, g, or t
  misc_feature (2171)..(2171): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaacccttttgggcggccttgggccctggaaaagtttttaaaacccttcggttggggcgcgcggcccccttgggttcggtgaacatgggccaaagcgcggtccccaggaaacaccgggcgcacgaccagggccgggnattcctcccnatnaaaaacgcccnggggncacacnnangttctggaaaaatcncgaaggagtccggggccacacgcggaccagc

SEQ ID NO: 732236 - DNA, 2101 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccagtaacaaaaacaaacgaaaaaacacaaaaaagggtgagacgccgggcaccagaaagattctaaacacaccgggggcacgggcccaagagaaggcacacgggcaagaggtgcccaggaaccggacgacaagaggggtccacaaaaag

SEQ ID NO: 732237 - DNA, 2106 bp, Homo sapiens
  misc_feature (1957)..(1957): n is a, c, g, or t
  misc_feature (2010)..(2010): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732238 - DNA, 2169 bp, Homo sapiens
  misc_feature (1957)..(1957): n is a, c, g, or t
  misc_feature (2169)..(2169): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732239 - DNA, 2126 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaccccatagaacaacaccaacacaacacaatcataaccaaacaactcacacccccacaacaaacaaaaactaattcaacctcactcacaaaaataccacaaaacaaagaaaacagacacaaaaaaaaaccacaagacacacagacctataatgcacaaaaacacaaaagag

SEQ ID NO: 732240 - DNA, 2137 bp, Homo sapiens
  misc_feature (1966)..(1966): n is a, c, g, or t
  misc_feature (2137)..(2137): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaanaagagaaaaaagacacacaacacgtggtggcacggcatcaggagcccgaggaaagcgtggcgagaaacatggagatgggagacgcgcgggcaccggaggtatagaggacacacgggcgacagaggagggccctaggaaaaccggggagagaacaagggccgggaattccan

SEQ ID NO: 732241 - DNA, 2226 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccataaaaaaaaaaccacaacaaaaacttttggcccccttgggccccggaaaagtttcaaaacattcgttggggcggggcgcaaggggaacgggaaccgggcaaagcggtccaaggaaacccgtgcgccagagaaaagagcggagagatttcccaccatgtaaaaaaagcccggggggaacaccggcgcgttctggaacacactccgagagggccctcagaggcacaaaacgggacgcatccagagggtgccagaggaaaccgcaataaaaccg

SEQ ID NO: 732242 - DNA, 2238 bp, Homo sapiens
  misc_feature (2154)..(2154): n is a, c, g, or t
  misc_feature (2164)..(2164): n is a, c, g, or t
  misc_feature (2167)..(2167): n is a, c, g, or t
  misc_feature (2178)..(2178): n is a, c, g, or t
  misc_feature (2183)..(2183): n is a, c, g, or t
  misc_feature (2189)..(2190): n is a, c, g, or t
  misc_feature (2192)..(2192): n is a, c, g, or t
  misc_feature (2207)..(2207): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaggaacaaaaaacaaaaaaaaaacctttttggggccgcgtgggccccttggaagaaacttttttcataaaaaccacctttcgtttgtgtagcgccgggggccccatagagtgatataggtcgaccacgtggtcaacacagatggtgttccctaaggagaaactgggggacaagtacacaatgcgcctgggnattcctcccnatnaaaaacgcccnggggncacacnnangttctggaaaaatcncgaaggagtccggggccacacgcggaccagc

SEQ ID NO: 732243 - DNA, 2022 bp, Homo sapiens
  misc_feature (1926)..(1926): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732244 - DNA, 2085 bp, Homo sapiens
  misc_feature (2085)..(2085): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732245 - DNA, 2049 bp, Homo sapiens
  misc_feature (1953)..(1953): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732246 - DNA, 2112 bp, Homo sapiens
  misc_feature (2112)..(2112): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732247 - DNA, 2138 bp, Homo sapiens
  misc_feature (2054)..(2054): n is a, c, g, or t
  misc_feature (2064)..(2064): n is a, c, g, or t
  misc_feature (2067)..(2067): n is a, c, g, or t
  misc_feature (2078)..(2078): n is a, c, g, or t
  misc_feature (2083)..(2083): n is a, c, g, or t
  misc_feature (2089)..(2090): n is a, c, g, or t
  misc_feature (2092)..(2092): n is a, c, g, or t
  misc_feature (2107)..(2107): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaacccttttgggcggccttgggccctggaaaagtttttaaaacccttcggttggggcgcgcggcccccttgggttcggtgaacatgggccaaagcgcggtccccaggaaacaccgggcgcacgaccagggccgggnattcctcccnatnaaaaacgcccnggggncacacnnangttctggaaaaatcncgaaggagtccggggccacacgcggaccagc

SEQ ID NO: 732248 - DNA, 2037 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccagtaacaaaaacaaacgaaaaaacacaaaaaagggtgagacgccgggcaccagaaagattctaaacacaccgggggcacgggcccaagagaaggcacacgggcaagaggtgcccaggaaccggacgacaagaggggtccacaaaaag

SEQ ID NO: 732249 - DNA, 2042 bp, Homo sapiens
  misc_feature (1893)..(1893): n is a, c, g, or t
  misc_feature (1946)..(1946): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732250 - DNA, 2105 bp, Homo sapiens
  misc_feature (1893)..(1893): n is a, c, g, or t
  misc_feature (2105)..(2105): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732251 - DNA, 2062 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaccccatagaacaacaccaacacaacacaatcataaccaaacaactcacacccccacaacaaacaaaaactaattcaacctcactcacaaaaataccacaaaacaaagaaaacagacacaaaaaaaaaccacaagacacacagacctataatgcacaaaaacacaaaagag

SEQ ID NO: 732252 - DNA, 2073 bp, Homo sapiens
  misc_feature (1902)..(1902): n is a, c, g, or t
  misc_feature (2073)..(2073): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaanaagagaaaaaagacacacaacacgtggtggcacggcatcaggagcccgaggaaagcgtggcgagaaacatggagatgggagacgcgcgggcaccggaggtatagaggacacacgggcgacagaggagggccctaggaaaaccggggagagaacaagggccgggaattccan

SEQ ID NO: 732253 - DNA, 2162 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccataaaaaaaaaaccacaacaaaaacttttggcccccttgggccccggaaaagtttcaaaacattcgttggggcggggcgcaaggggaacgggaaccgggcaaagcggtccaaggaaacccgtgcgccagagaaaagagcggagagatttcccaccatgtaaaaaaagcccggggggaacaccggcgcgttctggaacacactccgagagggccctcagaggcacaaaacgggacgcatccagagggtgccagaggaaaccgcaataaaaccg

SEQ ID NO: 732254 - DNA, 2174 bp, Homo sapiens
  misc_feature (2090)..(2090): n is a, c, g, or t
  misc_feature (2100)..(2100): n is a, c, g, or t
  misc_feature (2103)..(2103): n is a, c, g, or t
  misc_feature (2114)..(2114): n is a, c, g, or t
  misc_feature (2119)..(2119): n is a, c, g, or t
  misc_feature (2125)..(2126): n is a, c, g, or t
  misc_feature (2128)..(2128): n is a, c, g, or t
  misc_feature (2143)..(2143): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgacccaaaaaaaaaaggaacaaaaaacaaaaaaaaaacctttttggggccgcgtgggccccttggaagaaacttttttcataaaaaccacctttcgtttgtgtagcgccgggggccccatagagtgatataggtcgaccacgtggtcaacacagatggtgttccctaaggagaaactgggggacaagtacacaatgcgcctgggnattcctcccnatnaaaaacgcccnggggncacacnnangttctggaaaaatcncgaaggagtccggggccacacgcggaccagc

SEQ ID NO: 732255 - DNA, 2032 bp, Homo sapiens
  misc_feature (1936)..(1936): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732256 - DNA, 2095 bp, Homo sapiens
  misc_feature (2095)..(2095): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732257 - DNA, 2059 bp, Homo sapiens
  misc_feature (1963)..(1963): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732258 - DNA, 2122 bp, Homo sapiens
  misc_feature (2122)..(2122): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732259 - DNA, 2148 bp, Homo sapiens
  misc_feature (2064)..(2064): n is a, c, g, or t
  misc_feature (2074)..(2074): n is a, c, g, or t
  misc_feature (2077)..(2077): n is a, c, g, or t
  misc_feature (2088)..(2088): n is a, c, g, or t
  misc_feature (2093)..(2093): n is a, c, g, or t
  misc_feature (2099)..(2100): n is a, c, g, or t
  misc_feature (2102)..(2102): n is a, c, g, or t
  misc_feature (2117)..(2117): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaacaaaaaacccttttgggcggccttgggccctggaaaagtttttaaaacccttcggttggggcgcgcggcccccttgggttcggtgaacatgggccaaagcgcggtccccaggaaacaccgggcgcacgaccagggccgggnattcctcccnatnaaaaacgcccnggggncacacnnangttctggaaaaatcncgaaggagtccggggccacacgcggaccagc

SEQ ID NO: 732260 - DNA, 2047 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccagtaacaaaaacaaacgaaaaaacacaaaaaagggtgagacgccgggcaccagaaagattctaaacacaccgggggcacgggcccaagagaaggcacacgggcaagaggtgcccaggaaccggacgacaagaggggtccacaaaaag

SEQ ID NO: 732261 - DNA, 2052 bp, Homo sapiens
  misc_feature (1903)..(1903): n is a, c, g, or t
  misc_feature (1956)..(1956): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggggcgcntgggccgaaaatttttaaacccttttggggcggcggcctgtttgtgaccgggccaaggggtcccagagaaccggcgaagtggcgtggttcccccaa

SEQ ID NO: 732262 - DNA, 2115 bp, Homo sapiens
  misc_feature (1903)..(1903): n is a, c, g, or t
  misc_feature (2115)..(2115): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgggaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtcatgaacacaccttctgtgctggcatgtctaagtaccaagaagacacctgctatggcgatgcgggcagtgcctttgccgttcacgacctggaggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaangattgacccacaaaaaaaaaaaaaaaaaaaaaaaaaaaaaattttggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 732263 - DNA, 1731 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732264 - DNA, 1621 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732265 - DNA, 1677 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732266 - DNA, 1675 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732267 - DNA, 1639 bp, Homo sapiens
cgaattcggccattatggccgggggaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732268 - DNA, 1695 bp, Homo sapiens
cgaattcggccattatggccgggggaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732269 - DNA, 1677 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctgctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732270 - DNA, 1567 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732271 - DNA, 1792 bp, Homo sapiens
  misc_feature (1630)..(1630): n is a, c, g, or t
  misc_feature (1635)..(1635): n is a, c, g, or t
  misc_feature (1656)..(1656): n is a, c, g, or t
  misc_feature (1665)..(1665): n is a, c, g, or t
  misc_feature (1677)..(1677): n is a, c, g, or t
  misc_feature (1682)..(1683): n is a, c, g, or t
  misc_feature (1687)..(1687): n is a, c, g, or t
  misc_feature (1690)..(1690): n is a, c, g, or t
  misc_feature (1694)..(1694): n is a, c, g, or t
  misc_feature (1710)..(1710): n is a, c, g, or t
  misc_feature (1717)..(1717): n is a, c, g, or t
  misc_feature (1723)..(1723): n is a, c, g, or t
  misc_feature (1728)..(1728): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732272 - DNA, 1848 bp, Homo sapiens
  misc_feature (1686)..(1686): n is a, c, g, or t
  misc_feature (1691)..(1691): n is a, c, g, or t
  misc_feature (1712)..(1712): n is a, c, g, or t
  misc_feature (1721)..(1721): n is a, c, g, or t
  misc_feature (1733)..(1733): n is a, c, g, or t
  misc_feature (1738)..(1739): n is a, c, g, or t
  misc_feature (1743)..(1743): n is a, c, g, or t
  misc_feature (1746)..(1746): n is a, c, g, or t
  misc_feature (1750)..(1750): n is a, c, g, or t
  misc_feature (1766)..(1766): n is a, c, g, or t
  misc_feature (1773)..(1773): n is a, c, g, or t
  misc_feature (1779)..(1779): n is a, c, g, or t
  misc_feature (1784)..(1784): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732273 - DNA, 1623 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732274 - DNA, 1621 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732275 - DNA, 1846 bp, Homo sapiens
  misc_feature (1684)..(1684): n is a, c, g, or t
  misc_feature (1689)..(1689): n is a, c, g, or t
  misc_feature (1710)..(1710): n is a, c, g, or t
  misc_feature (1719)..(1719): n is a, c, g, or t
  misc_feature (1731)..(1731): n is a, c, g, or t
  misc_feature (1736)..(1737): n is a, c, g, or t
  misc_feature (1741)..(1741): n is a, c, g, or t
  misc_feature (1744)..(1744): n is a, c, g, or t
  misc_feature (1748)..(1748): n is a, c, g, or t
  misc_feature (1764)..(1764): n is a, c, g, or t
  misc_feature (1771)..(1771): n is a, c, g, or t
  misc_feature (1777)..(1777): n is a, c, g, or t
  misc_feature (1782)..(1782): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732276 - DNA, 1902 bp, Homo sapiens
  misc_feature (1740)..(1740): n is a, c, g, or t
  misc_feature (1745)..(1745): n is a, c, g, or t
  misc_feature (1766)..(1766): n is a, c, g, or t
  misc_feature (1775)..(1775): n is a, c, g, or t
  misc_feature (1787)..(1787): n is a, c, g, or t
  misc_feature (1792)..(1793): n is a, c, g, or t
  misc_feature (1797)..(1797): n is a, c, g, or t
  misc_feature (1800)..(1800): n is a, c, g, or t
  misc_feature (1804)..(1804): n is a, c, g, or t
  misc_feature (1820)..(1820): n is a, c, g, or t
  misc_feature (1827)..(1827): n is a, c, g, or t
  misc_feature (1833)..(1833): n is a, c, g, or t
  misc_feature (1838)..(1838): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732277 - DNA, 1677 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732278 - DNA, 1848 bp, Homo sapiens
  misc_feature (1686)..(1686): n is a, c, g, or t
  misc_feature (1691)..(1691): n is a, c, g, or t
  misc_feature (1712)..(1712): n is a, c, g, or t
  misc_feature (1721)..(1721): n is a, c, g, or t
  misc_feature (1733)..(1733): n is a, c, g, or t
  misc_feature (1738)..(1739): n is a, c, g, or t
  misc_feature (1743)..(1743): n is a, c, g, or t
  misc_feature (1746)..(1746): n is a, c, g, or t
  misc_feature (1750)..(1750): n is a, c, g, or t
  misc_feature (1766)..(1766): n is a, c, g, or t
  misc_feature (1773)..(1773): n is a, c, g, or t
  misc_feature (1779)..(1779): n is a, c, g, or t
  misc_feature (1784)..(1784): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctgctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732279 - DNA, 1623 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctgctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732280 - DNA, 1585 bp, Homo sapiens
cgaattcggccattatggccgggggaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732281 - DNA, 1810 bp, Homo sapiens
  misc_feature (1648)..(1648): n is a, c, g, or t
  misc_feature (1653)..(1653): n is a, c, g, or t
  misc_feature (1674)..(1674): n is a, c, g, or t
  misc_feature (1683)..(1683): n is a, c, g, or t
  misc_feature (1695)..(1695): n is a, c, g, or t
  misc_feature (1700)..(1701): n is a, c, g, or t
  misc_feature (1705)..(1705): n is a, c, g, or t
  misc_feature (1708)..(1708): n is a, c, g, or t
  misc_feature (1712)..(1712): n is a, c, g, or t
  misc_feature (1728)..(1728): n is a, c, g, or t
  misc_feature (1735)..(1735): n is a, c, g, or t
  misc_feature (1741)..(1741): n is a, c, g, or t
  misc_feature (1746)..(1746): n is a, c, g, or t
cgaattcggccattatggccgggggaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732282 - DNA, 1866 bp, Homo sapiens
  misc_feature (1704)..(1704): n is a, c, g, or t
  misc_feature (1709)..(1709): n is a, c, g, or t
  misc_feature (1730)..(1730): n is a, c, g, or t
  misc_feature (1739)..(1739): n is a, c, g, or t
  misc_feature (1751)..(1751): n is a, c, g, or t
  misc_feature (1756)..(1757): n is a, c, g, or t
  misc_feature (1761)..(1761): n is a, c, g, or t
  misc_feature (1764)..(1764): n is a, c, g, or t
  misc_feature (1768)..(1768): n is a, c, g, or t
  misc_feature (1784)..(1784): n is a, c, g, or t
  misc_feature (1791)..(1791): n is a, c, g, or t
  misc_feature (1797)..(1797): n is a, c, g, or t
  misc_feature (1802)..(1802): n is a, c, g, or t
cgaattcggccattatggccgggggaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732283 - DNA, 1641 bp, Homo sapiens
cgaattcggccattatggccgggggaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732284 - DNA, 1565 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732285 - DNA, 1621 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732286 - DNA, 1619 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732287 - DNA, 1675 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732288 - DNA, 814 bp, Homo sapiens
  misc_feature (731)..(731): n is a, c, g, or t
  misc_feature (750)..(750): n is a, c, g, or t
  misc_feature (756)..(756): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggggccnttccttttgccgttaaatnaggccngacacaaagggatccctcaaggggggaaagcttcccccaccacccttttgggacggga

SEQ ID NO: 732289 - DNA, 804 bp, Homo sapiens
  misc_feature (756)..(756): n is a, c, g, or t
  misc_feature (782)..(782): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaccattcctttctgcgttaatgaggcctgacancatggatctggcaggttggaagtctntcagcaccagcatgtgcacgga

SEQ ID NO: 732290 - DNA, 1621 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctgctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732291 - DNA, 1583 bp, Homo sapiens
cgaattcggccattatggccgggggaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732292 - DNA, 1639 bp, Homo sapiens
cgaattcggccattatggccgggggaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732293 - DNA, 778 bp, Homo sapiens
  misc_feature (695)..(695): n is a, c, g, or t
  misc_feature (714)..(714): n is a, c, g, or t
  misc_feature (720)..(720): n is a, c, g, or t
cgaattcggccattatggccgggggaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggggccnttccttttgccgttaaatnaggccngacacaaagggatccctcaaggggggaaagcttcccccaccacccttttgggacggga

SEQ ID NO: 732294 - DNA, 768 bp, Homo sapiens
  misc_feature (720)..(720): n is a, c, g, or t
  misc_feature (746)..(746): n is a, c, g, or t
cgaattcggccattatggccgggggaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaccattcctttctgcgttaatgaggcctgacancatggatctggcaggttggaagtctntcagcaccagcatgtgcacgga

SEQ ID NO: 732295 - DNA, 657 bp, Homo sapiens
attgcacagagactttaaaagtggctaagaatacaaaataagtaaataaaaatgatcctttgcctaggaaattccttccttcttcgagggaagacactccagatacctccatgagctttgcttccacacagctcaggtgatgctgacaggtcttcccagcgcaggtgttatcagcagagggcacactccctccccagtcctccaccaggctccacaggaaatgccagggcaggatttaaaggaaggtttatcacccccactttatataactgggtaacagagtcatagccagaattggaagcagcttttccagggaacacacaatcaggaaaggagtgtgggtttccagcatctccccacaacccactgtttgctcgatgactccagggatggtctttgtgacaaagttttattaatccattgcaaaatgagaaaaataccagcaattctatgtatatctaagagtgtatattgcctatattcaactgtgaatttgtgtgtgtaacacaaattcttccactgccctttcttgcctaaggactgattgggactgttcatattctcagagtatagcctcctgattttttagattttaaatgatctgtctttaattgtattgatgacaaatcatactttttcaatatccttacttggcaa

SEQ ID NO: 732296 - DNA, 1140 bp, Homo sapiens
gcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggaagcccagtctcttcaaaacacagctccccactgctggcctgaccctccacattcagactacccaaactccttttataaagcaactaattgcttttgagtctccagcactgtctaaaaaaacaaacaaaaaaaaaacctttccagtttctacatagccatacccctaagtaccgctatagttcaaggagtgtgctaagagtgaatagttttttgttttaattttgactttccacagctcccaaaaacaagggataagaaatgacaaggggagtgttagaggcgtctgtttcttaaaaccattatcactcccgggcttagaaaatacttcacaatgatggccatttcatgaggctgtctctccagaaactcaaattgcacagagactttaaaagtggctaagaatacaaaataagtaaataatacctccatgagctttgcttccacacagctcaggtgatgctgacaggtcttcccagcgcaggtgttatcagcagagggcacactccctccccagtcctccaccaggctccacaggaaatgccagggcaggatttaaaggaaggtttatcacccccactttatataactgggtaacagagtcatagccagaattggaagcagcttttccagggaacacacaatcaggaaaggagtgtgggtttccagcatctccccacaacccactgtttgctcgatgactccagggatggtctttgtgacaaagttttattaatccattgcaaaatgagaaaaataccagcaattctatgtatatctaagagtgtatattgcctatattcaactgtgaatttgtgtgtgtaacacaaattcttccactgccctttcttgcctaaggactgattgggactgttcatattctcagagtatagcctcctgattttttagattttaaatgatctgtctttaattgtattgatgacaaatcatactttttcaatatccttacttggcaa

SEQ ID NO: 732297 - DNA, 1278 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacagtagcctggggaggagataaaacaagttggttaaatgaggatcagaaagaaggacaagaaagggaagagaagtcactccattgaacacctgctgagctcttggccaagtgcctttgctgatcactactgactggggagttcaaggctggtaacctcagttttttagatgagaaaactagggctgagagacagcaagtaacttgtccaaggccccaaaagtaagtaagtaagtaggagagttagactttaaactcactcctgtgtgactccaaaggctgtggaagctctttctactgtggccccaatcccccgggccagaatcagaccttccaggtgccaccatagtcatcattttgaaccttgtgtgtaggctgatgagaacattcagagtctttctgcccacctcaaagaagtcctctcaagagaactagcaaagctggttcacagaggtctgtcaggacagaattatccagcacatgccttcccataatattttcttaacaaaaagagtttcccagtgtccagaatacaatctcttcagctcaccacagggtctactattacagagccatttcctgccaggtgcccaaagtgcaccctcatttgatccacattttttaaaggaatcttgccatgcagtctcaccctctgattcccagagcccagtctcttcaaaacacagctccccactgctggcctgaccctccacattcagactacccaaactccttttataaagcaactaattgcttttgagtctccag

SEQ ID NO: 732298 - DNA, 1605 bp, Homo sapiens
tggaggaggagggagcaatgagtatgtggcaggagttcaagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctgctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732299 - DNA, 1776 bp, Homo sapiens
  misc_feature (1614)..(1614): n is a, c, g, or t
  misc_feature (1619)..(1619): n is a, c, g, or t
  misc_feature (1640)..(1640): n is a, c, g, or t
  misc_feature (1649)..(1649): n is a, c, g, or t
  misc_feature (1661)..(1661): n is a, c, g, or t
  misc_feature (1666)..(1667): n is a, c, g, or t
  misc_feature (1671)..(1671): n is a, c, g, or t
  misc_feature (1674)..(1674): n is a, c, g, or t
  misc_feature (1678)..(1678): n is a, c, g, or t
  misc_feature (1694)..(1694): n is a, c, g, or t
  misc_feature (1701)..(1701): n is a, c, g, or t
  misc_feature (1707)..(1707): n is a, c, g, or t
  misc_feature (1712)..(1712): n is a, c, g, or t
tggaggaggagggagcaatgagtatgtggcaggagttcaagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctgctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732300 - DNA, 1551 bp, Homo sapiens
tggaggaggagggagcaatgagtatgtggcaggagttcaagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctgctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732301 - DNA, 1549 bp, Homo sapiens
tggaggaggagggagcaatgagtatgtggcaggagttcaagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctgctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732302 - DNA, 1659 bp, Homo sapiens
tggaggaggagggagcaatgagtatgtggcaggagttcaagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732303 - DNA, 1830 bp, Homo sapiens
  misc_feature (1668)..(1668): n is a, c, g, or t
  misc_feature (1673)..(1673): n is a, c, g, or t
  misc_feature (1694)..(1694): n is a, c, g, or t
  misc_feature (1703)..(1703): n is a, c, g, or t
  misc_feature (1715)..(1715): n is a, c, g, or t
  misc_feature (1720)..(1721): n is a, c, g, or t
  misc_feature (1725)..(1725): n is a, c, g, or t
  misc_feature (1728)..(1728): n is a, c, g, or t
  misc_feature (1732)..(1732): n is a, c, g, or t
  misc_feature (1748)..(1748): n is a, c, g, or t
  misc_feature (1755)..(1755): n is a, c, g, or t
  misc_feature (1761)..(1761): n is a, c, g, or t
  misc_feature (1766)..(1766): n is a, c, g, or t
tggaggaggagggagcaatgagtatgtggcaggagttcaagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732304 - DNA, 1605 bp, Homo sapiens
tggaggaggagggagcaatgagtatgtggcaggagttcaagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732305 - DNA, 1603 bp, Homo sapiens
tggaggaggagggagcaatgagtatgtggcaggagttcaagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732306 - DNA, 1503 bp, Homo sapiens
aaaataaggcatctgctgagtgtataaccattttacctcttgtttttagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732307 - DNA, 1557 bp, Homo sapiens
aaaataaggcatctgctgagtgtataaccattttacctcttgtttttagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732308 - DNA, 1728 bp, Homo sapiens
  misc_feature (1566)..(1566): n is a, c, g, or t
  misc_feature (1571)..(1571): n is a, c, g, or t
  misc_feature (1592)..(1592): n is a, c, g, or t
  misc_feature (1601)..(1601): n is a, c, g, or t
  misc_feature (1613)..(1613): n is a, c, g, or t
  misc_feature (1618)..(1619): n is a, c, g, or t
  misc_feature (1623)..(1623): n is a, c, g, or t
  misc_feature (1626)..(1626): n is a, c, g, or t
  misc_feature (1630)..(1630): n is a, c, g, or t
  misc_feature (1646)..(1646): n is a, c, g, or t
  misc_feature (1653)..(1653): n is a, c, g, or t
  misc_feature (1659)..(1659): n is a, c, g, or t
  misc_feature (1664)..(1664): n is a, c, g, or t
aaaataaggcatctgctgagtgtataaccattttacctcttgtttttagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732309 - DNA, 1501 bp, Homo sapiens
aaaataaggcatctgctgagtgtataaccattttacctcttgtttttagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732310 - DNA, 1613 bp, Homo sapiens
aaaataaggcatctgctgagtgtataaccattttacctcttgtttttagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732311 - DNA, 1784 bp, Homo sapiens
  misc_feature (1622)..(1622): n is a, c, g, or t
  misc_feature (1627)..(1627): n is a, c, g, or t
  misc_feature (1648)..(1648): n is a, c, g, or t
  misc_feature (1657)..(1657): n is a, c, g, or t
  misc_feature (1669)..(1669): n is a, c, g, or t
  misc_feature (1674)..(1675): n is a, c, g, or t
  misc_feature (1679)..(1679): n is a, c, g, or t
  misc_feature (1682)..(1682): n is a, c, g, or t
  misc_feature (1686)..(1686): n is a, c, g, or t
  misc_feature (1702)..(1702): n is a, c, g, or t
  misc_feature (1709)..(1709): n is a, c, g, or t
  misc_feature (1715)..(1715): n is a, c, g, or t
  misc_feature (1720)..(1720): n is a, c, g, or t
aaaataaggcatctgctgagtgtataaccattttacctcttgtttttagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732312 - DNA, 1559 bp, Homo sapiens
aaaataaggcatctgctgagtgtataaccattttacctcttgtttttagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732313 - DNA, 1557 bp, Homo sapiens
aaaataaggcatctgctgagtgtataaccattttacctcttgtttttagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732314 - DNA, 1408 bp, Homo sapiens
atccatggaaactcaccggggaagagtcattttctatcggctttggacttctgctatgaaatggcaattcctttgagccagtctgtctaaagtcggcagcaaaggagaagcagatgaagggagtagaaaagagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732315 - DNA, 1462 bp, Homo sapiens
atccatggaaactcaccggggaagagtcattttctatcggctttggacttctgctatgaaatggcaattcctttgagccagtctgtctaaagtcggcagcaaaggagaagcagatgaagggagtagaaaagagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732316 - DNA, 1633 bp, Homo sapiens
  misc_feature (1471)..(1471): n is a, c, g, or t
  misc_feature (1476)..(1476): n is a, c, g, or t
  misc_feature (1497)..(1497): n is a, c, g, or t
  misc_feature (1506)..(1506): n is a, c, g, or t
  misc_feature (1518)..(1518): n is a, c, g, or t
  misc_feature (1523)..(1524): n is a, c, g, or t
  misc_feature (1528)..(1528): n is a, c, g, or t
  misc_feature (1531)..(1531): n is a, c, g, or t
  misc_feature (1535)..(1535): n is a, c, g, or t
  misc_feature (1551)..(1551): n is a, c, g, or t
  misc_feature (1558)..(1558): n is a, c, g, or t
  misc_feature (1564)..(1564): n is a, c, g, or t
  misc_feature (1569)..(1569): n is a, c, g, or t
atccatggaaactcaccggggaagagtcattttctatcggctttggacttctgctatgaaatggcaattcctttgagccagtctgtctaaagtcggcagcaaaggagaagcagatgaagggagtagaaaagagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732317 - DNA, 1406 bp, Homo sapiens
atccatggaaactcaccggggaagagtcattttctatcggctttggacttctgctatgaaatggcaattcctttgagccagtctgtctaaagtcggcagcaaaggagaagcagatgaagggagtagaaaagagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732318 - DNA, 1294 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacagtagcctggggaggagataaaacaagttggttaaatgaggatcagaaagaaggacaagaaagggaagagaagtcactccattgaacacctgctgagctcttggccaagtgcctttgctgatcactactgactggggagttcaaggctggtaacctcagttttttagatgagaaaactagggctgagagacagcaagtaacttgtccaaggccccaaaagtaagtaagtaagtaggagagttagactttaaactcactcctgtgtgactccaaaggctgtggaagctctttctactgtggccccaatcccccgggccagaatcagaccttccaggtgccaccatagtcatcattttgaaccttgtgtgtaggctgatgagaacattcagagtctttctgcccacctcaaagaagtcctctcaagagaactagcaaagctggttcacagaggtctgtcaggacagaattatccagcacatgccttcccataatattttcttaacaaaaagagtttcccagtgtccagaatacaatctcttcagctcaccacagggtctactattacagagccatttcctgccaggtgcccaaagtgcaccctcatttgatccacattttttaaaggaatcttgccatgcagtctcaccctctgattcccagagcccagtctcttcaaaacacagctccccactgctggcctgaccctccacattcagactacccaaactccttttataaagcaactaattgcttttgagtctccag

SEQ ID NO: 732319 - DNA, 1637 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732320 - DNA, 1691 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732321 - DNA, 1862 bp, Homo sapiens
  misc_feature (1700)..(1700): n is a, c, g, or t
  misc_feature (1705)..(1705): n is a, c, g, or t
  misc_feature (1726)..(1726): n is a, c, g, or t
  misc_feature (1735)..(1735): n is a, c, g, or t
  misc_feature (1747)..(1747): n is a, c, g, or t
  misc_feature (1752)..(1753): n is a, c, g, or t
  misc_feature (1757)..(1757): n is a, c, g, or t
  misc_feature (1760)..(1760): n is a, c, g, or t
  misc_feature (1764)..(1764): n is a, c, g, or t
  misc_feature (1780)..(1780): n is a, c, g, or t
  misc_feature (1787)..(1787): n is a, c, g, or t
  misc_feature (1793)..(1793): n is a, c, g, or t
  misc_feature (1798)..(1798): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732322 - DNA, 1927 bp, Homo sapiens
  misc_feature (1713)..(1713): n is a, c, g, or t
  misc_feature (1718)..(1718): n is a, c, g, or t
  misc_feature (1765)..(1765): n is a, c, g, or t
  misc_feature (1770)..(1770): n is a, c, g, or t
  misc_feature (1791)..(1791): n is a, c, g, or t
  misc_feature (1800)..(1800): n is a, c, g, or t
  misc_feature (1812)..(1812): n is a, c, g, or t
  misc_feature (1817)..(1818): n is a, c, g, or t
  misc_feature (1822)..(1822): n is a, c, g, or t
  misc_feature (1825)..(1825): n is a, c, g, or t
  misc_feature (1829)..(1829): n is a, c, g, or t
  misc_feature (1845)..(1845): n is a, c, g, or t
  misc_feature (1852)..(1852): n is a, c, g, or t
  misc_feature (1858)..(1858): n is a, c, g, or t
  misc_feature (1863)..(1863): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732323 - DNA, 1638 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgaatctcctattccttcacacagttcaacataaagagcaataaatgttttaatgcttaa

SEQ ID NO: 732324 - DNA, 1635 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732325 - DNA, 1873 bp, Homo sapiens
  misc_feature (1659)..(1659): n is a, c, g, or t
  misc_feature (1664)..(1664): n is a, c, g, or t
  misc_feature (1711)..(1711): n is a, c, g, or t
  misc_feature (1716)..(1716): n is a, c, g, or t
  misc_feature (1737)..(1737): n is a, c, g, or t
  misc_feature (1746)..(1746): n is a, c, g, or t
  misc_feature (1758)..(1758): n is a, c, g, or t
  misc_feature (1763)..(1764): n is a, c, g, or t
  misc_feature (1768)..(1768): n is a, c, g, or t
  misc_feature (1771)..(1771): n is a, c, g, or t
  misc_feature (1775)..(1775): n is a, c, g, or t
  misc_feature (1791)..(1791): n is a, c, g, or t
  misc_feature (1798)..(1798): n is a, c, g, or t
  misc_feature (1804)..(1804): n is a, c, g, or t
  misc_feature (1809)..(1809): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732326 - DNA, 1640 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttgattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732327 - DNA, 1876 bp, Homo sapiens
  misc_feature (1662)..(1662): n is a, c, g, or t
  misc_feature (1667)..(1667): n is a, c, g, or t
  misc_feature (1714)..(1714): n is a, c, g, or t
  misc_feature (1719)..(1719): n is a, c, g, or t
  misc_feature (1740)..(1740): n is a, c, g, or t
  misc_feature (1749)..(1749): n is a, c, g, or t
  misc_feature (1761)..(1761): n is a, c, g, or t
  misc_feature (1766)..(1767): n is a, c, g, or t
  misc_feature (1771)..(1771): n is a, c, g, or t
  misc_feature (1774)..(1774): n is a, c, g, or t
  misc_feature (1778)..(1778): n is a, c, g, or t
  misc_feature (1794)..(1794): n is a, c, g, or t
  misc_feature (1801)..(1801): n is a, c, g, or t
  misc_feature (1807)..(1807): n is a, c, g, or t
  misc_feature (1812)..(1812): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttgattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732328 - DNA, 1694 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttgattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732329 - DNA, 1865 bp, Homo sapiens
  misc_feature (1703)..(1703): n is a, c, g, or t
  misc_feature (1708)..(1708): n is a, c, g, or t
  misc_feature (1729)..(1729): n is a, c, g, or t
  misc_feature (1738)..(1738): n is a, c, g, or t
  misc_feature (1750)..(1750): n is a, c, g, or t
  misc_feature (1755)..(1756): n is a, c, g, or t
  misc_feature (1760)..(1760): n is a, c, g, or t
  misc_feature (1763)..(1763): n is a, c, g, or t
  misc_feature (1767)..(1767): n is a, c, g, or t
  misc_feature (1783)..(1783): n is a, c, g, or t
  misc_feature (1790)..(1790): n is a, c, g, or t
  misc_feature (1796)..(1796): n is a, c, g, or t
  misc_feature (1801)..(1801): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttgattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732330 - DNA, 1930 bp, Homo sapiens
  misc_feature (1716)..(1716): n is a, c, g, or t
  misc_feature (1721)..(1721): n is a, c, g, or t
  misc_feature (1768)..(1768): n is a, c, g, or t
  misc_feature (1773)..(1773): n is a, c, g, or t
  misc_feature (1794)..(1794): n is a, c, g, or t
  misc_feature (1803)..(1803): n is a, c, g, or t
  misc_feature (1815)..(1815): n is a, c, g, or t
  misc_feature (1820)..(1821): n is a, c, g, or t
  misc_feature (1825)..(1825): n is a, c, g, or t
  misc_feature (1828)..(1828): n is a, c, g, or t
  misc_feature (1832)..(1832): n is a, c, g, or t
  misc_feature (1848)..(1848): n is a, c, g, or t
  misc_feature (1855)..(1855): n is a, c, g, or t
  misc_feature (1861)..(1861): n is a, c, g, or t
  misc_feature (1866)..(1866): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttgattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732331 - DNA, 1583 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732332 - DNA, 1637 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732333 - DNA, 1808 bp, Homo sapiens
  misc_feature (1646)..(1646): n is a, c, g, or t
  misc_feature (1651)..(1651): n is a, c, g, or t
  misc_feature (1672)..(1672): n is a, c, g, or t
  misc_feature (1681)..(1681): n is a, c, g, or t
  misc_feature (1693)..(1693): n is a, c, g, or t
  misc_feature (1698)..(1699): n is a, c, g, or t
  misc_feature (1703)..(1703): n is a, c, g, or t
  misc_feature (1706)..(1706): n is a, c, g, or t
  misc_feature (1710)..(1710): n is a, c, g, or t
  misc_feature (1726)..(1726): n is a, c, g, or t
  misc_feature (1733)..(1733): n is a, c, g, or t
  misc_feature (1739)..(1739): n is a, c, g, or t
  misc_feature (1744)..(1744): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732334 - DNA, 1873 bp, Homo sapiens
  misc_feature (1659)..(1659): n is a, c, g, or t
  misc_feature (1664)..(1664): n is a, c, g, or t
  misc_feature (1711)..(1711): n is a, c, g, or t
  misc_feature (1716)..(1716): n is a, c, g, or t
  misc_feature (1737)..(1737): n is a, c, g, or t
  misc_feature (1746)..(1746): n is a, c, g, or t
  misc_feature (1758)..(1758): n is a, c, g, or t
  misc_feature (1763)..(1764): n is a, c, g, or t
  misc_feature (1768)..(1768): n is a, c, g, or t
  misc_feature (1771)..(1771): n is a, c, g, or t
  misc_feature (1775)..(1775): n is a, c, g, or t
  misc_feature (1791)..(1791): n is a, c, g, or t
  misc_feature (1798)..(1798): n is a, c, g, or t
  misc_feature (1804)..(1804): n is a, c, g, or t
  misc_feature (1809)..(1809): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732335 - DNA, 1584 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgaatctcctattccttcacacagttcaacataaagagcaataaatgttttaatgcttaa

SEQ ID NO: 732336 - DNA, 1581 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732337 - DNA, 1819 bp, Homo sapiens
  misc_feature (1605)..(1605): n is a, c, g, or t
  misc_feature (1610)..(1610): n is a, c, g, or t
  misc_feature (1657)..(1657): n is a, c, g, or t
  misc_feature (1662)..(1662): n is a, c, g, or t
  misc_feature (1683)..(1683): n is a, c, g, or t
  misc_feature (1692)..(1692): n is a, c, g, or t
  misc_feature (1704)..(1704): n is a, c, g, or t
  misc_feature (1709)..(1710): n is a, c, g, or t
  misc_feature (1714)..(1714): n is a, c, g, or t
  misc_feature (1717)..(1717): n is a, c, g, or t
  misc_feature (1721)..(1721): n is a, c, g, or t
  misc_feature (1737)..(1737): n is a, c, g, or t
  misc_feature (1744)..(1744): n is a, c, g, or t
  misc_feature (1750)..(1750): n is a, c, g, or t
  misc_feature (1755)..(1755): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732338 - DNA, 1693 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732339 - DNA, 1864 bp, Homo sapiens
  misc_feature (1702)..(1702): n is a, c, g, or t
  misc_feature (1707)..(1707): n is a, c, g, or t
  misc_feature (1728)..(1728): n is a, c, g, or t
  misc_feature (1737)..(1737): n is a, c, g, or t
  misc_feature (1749)..(1749): n is a, c, g, or t
  misc_feature (1754)..(1755): n is a, c, g, or t
  misc_feature (1759)..(1759): n is a, c, g, or t
  misc_feature (1762)..(1762): n is a, c, g, or t
  misc_feature (1766)..(1766): n is a, c, g, or t
  misc_feature (1782)..(1782): n is a, c, g, or t
  misc_feature (1789)..(1789): n is a, c, g, or t
  misc_feature (1795)..(1795): n is a, c, g, or t
  misc_feature (1800)..(1800): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732340 - DNA, 1929 bp, Homo sapiens
  misc_feature (1715)..(1715): n is a, c, g, or t
  misc_feature (1720)..(1720): n is a, c, g, or t
  misc_feature (1767)..(1767): n is a, c, g, or t
  misc_feature (1772)..(1772): n is a, c, g, or t
  misc_feature (1793)..(1793): n is a, c, g, or t
  misc_feature (1802)..(1802): n is a, c, g, or t
  misc_feature (1814)..(1814): n is a, c, g, or t
  misc_feature (1819)..(1820): n is a, c, g, or t
  misc_feature (1824)..(1824): n is a, c, g, or t
  misc_feature (1827)..(1827): n is a, c, g, or t
  misc_feature (1831)..(1831): n is a, c, g, or t
  misc_feature (1847)..(1847): n is a, c, g, or t
  misc_feature (1854)..(1854): n is a, c, g, or t
  misc_feature (1860)..(1860): n is a, c, g, or t
  misc_feature (1865)..(1865): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732341 - DNA, 1639 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732342 - DNA, 1640 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgaatctcctattccttcacacagttcaacataaagagcaataaatgttttaatgcttaa

SEQ ID NO: 732343 - DNA, 1637 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732344 - DNA, 1875 bp, Homo sapiens
  misc_feature (1661)..(1661): n is a, c, g, or t
  misc_feature (1666)..(1666): n is a, c, g, or t
  misc_feature (1713)..(1713): n is a, c, g, or t
  misc_feature (1718)..(1718): n is a, c, g, or t
  misc_feature (1739)..(1739): n is a, c, g, or t
  misc_feature (1748)..(1748): n is a, c, g, or t
  misc_feature (1760)..(1760): n is a, c, g, or t
  misc_feature (1765)..(1766): n is a, c, g, or t
  misc_feature (1770)..(1770): n is a, c, g, or t
  misc_feature (1773)..(1773): n is a, c, g, or t
  misc_feature (1777)..(1777): n is a, c, g, or t
  misc_feature (1793)..(1793): n is a, c, g, or t
  misc_feature (1800)..(1800): n is a, c, g, or t
  misc_feature (1806)..(1806): n is a, c, g, or t
  misc_feature (1811)..(1811): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732345 - DNA, 1747 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732346 - DNA, 1918 bp, Homo sapiens
  misc_feature (1756)..(1756): n is a, c, g, or t
  misc_feature (1761)..(1761): n is a, c, g, or t
  misc_feature (1782)..(1782): n is a, c, g, or t
  misc_feature (1791)..(1791): n is a, c, g, or t
  misc_feature (1803)..(1803): n is a, c, g, or t
  misc_feature (1808)..(1809): n is a, c, g, or t
  misc_feature (1813)..(1813): n is a, c, g, or t
  misc_feature (1816)..(1816): n is a, c, g, or t
  misc_feature (1820)..(1820): n is a, c, g, or t
  misc_feature (1836)..(1836): n is a, c, g, or t
  misc_feature (1843)..(1843): n is a, c, g, or t
  misc_feature (1849)..(1849): n is a, c, g, or t
  misc_feature (1854)..(1854): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732347 - DNA, 1983 bp, Homo sapiens
  misc_feature (1769)..(1769): n is a, c, g, or t
  misc_feature (1774)..(1774): n is a, c, g, or t
  misc_feature (1821)..(1821): n is a, c, g, or t
  misc_feature (1826)..(1826): n is a, c, g, or t
  misc_feature (1847)..(1847): n is a, c, g, or t
  misc_feature (1856)..(1856): n is a, c, g, or t
  misc_feature (1868)..(1868): n is a, c, g, or t
  misc_feature (1873)..(1874): n is a, c, g, or t
  misc_feature (1878)..(1878): n is a, c, g, or t
  misc_feature (1881)..(1881): n is a, c, g, or t
  misc_feature (1885)..(1885): n is a, c, g, or t
  misc_feature (1901)..(1901): n is a, c, g, or t
  misc_feature (1908)..(1908): n is a, c, g, or t
  misc_feature (1914)..(1914): n is a, c, g, or t
  misc_feature (1919)..(1919): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732348 - DNA, 1693 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 732349 - DNA, 1694 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgaatctcctattccttcacacagttcaacataaagagcaataaatgttttaatgcttaa

SEQ ID NO: 732350 - DNA, 1691 bp, Homo sapiens
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 732351 - DNA, 1929 bp, Homo sapiens
  misc_feature (1715)..(1715): n is a, c, g, or t
  misc_feature (1720)..(1720): n is a, c, g, or t
  misc_feature (1767)..(1767): n is a, c, g, or t
  misc_feature (1772)..(1772): n is a, c, g, or t
  misc_feature (1793)..(1793): n is a, c, g, or t
  misc_feature (1802)..(1802): n is a, c, g, or t
  misc_feature (1814)..(1814): n is a, c, g, or t
  misc_feature (1819)..(1820): n is a, c, g, or t
  misc_feature (1824)..(1824): n is a, c, g, or t
  misc_feature (1827)..(1827): n is a, c, g, or t
  misc_feature (1831)..(1831): n is a, c, g, or t
  misc_feature (1847)..(1847): n is a, c, g, or t
  misc_feature (1854)..(1854): n is a, c, g, or t
  misc_feature (1860)..(1860): n is a, c, g, or t
  misc_feature (1865)..(1865): n is a, c, g, or t
gcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732352 - DNA, 1857 bp, Homo sapiens
  misc_feature (1643)..(1643): n is a, c, g, or t
  misc_feature (1648)..(1648): n is a, c, g, or t
  misc_feature (1695)..(1695): n is a, c, g, or t
  misc_feature (1700)..(1700): n is a, c, g, or t
  misc_feature (1721)..(1721): n is a, c, g, or t
  misc_feature (1730)..(1730): n is a, c, g, or t
  misc_feature (1742)..(1742): n is a, c, g, or t
  misc_feature (1747)..(1748): n is a, c, g, or t
  misc_feature (1752)..(1752): n is a, c, g, or t
  misc_feature (1755)..(1755): n is a, c, g, or t
  misc_feature (1759)..(1759): n is a, c, g, or t
  misc_feature (1775)..(1775): n is a, c, g, or t
  misc_feature (1782)..(1782): n is a, c, g, or t
  misc_feature (1788)..(1788): n is a, c, g, or t
  misc_feature (1793)..(1793): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732353 - DNA, 1568 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgaatctcctattccttcacacagttcaacataaagagcaataaatgttttaatgcttaa

SEQ ID NO: 732354 - DNA, 1803 bp, Homo sapiens
  misc_feature (1589)..(1589): n is a, c, g, or t
  misc_feature (1594)..(1594): n is a, c, g, or t
  misc_feature (1641)..(1641): n is a, c, g, or t
  misc_feature (1646)..(1646): n is a, c, g, or t
  misc_feature (1667)..(1667): n is a, c, g, or t
  misc_feature (1676)..(1676): n is a, c, g, or t
  misc_feature (1688)..(1688): n is a, c, g, or t
  misc_feature (1693)..(1694): n is a, c, g, or t
  misc_feature (1698)..(1698): n is a, c, g, or t
  misc_feature (1701)..(1701): n is a, c, g, or t
  misc_feature (1705)..(1705): n is a, c, g, or t
  misc_feature (1721)..(1721): n is a, c, g, or t
  misc_feature (1728)..(1728): n is a, c, g, or t
  misc_feature (1734)..(1734): n is a, c, g, or t
  misc_feature (1739)..(1739): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732355 - DNA, 1913 bp, Homo sapiens
  misc_feature (1699)..(1699): n is a, c, g, or t
  misc_feature (1704)..(1704): n is a, c, g, or t
  misc_feature (1751)..(1751): n is a, c, g, or t
  misc_feature (1756)..(1756): n is a, c, g, or t
  misc_feature (1777)..(1777): n is a, c, g, or t
  misc_feature (1786)..(1786): n is a, c, g, or t
  misc_feature (1798)..(1798): n is a, c, g, or t
  misc_feature (1803)..(1804): n is a, c, g, or t
  misc_feature (1808)..(1808): n is a, c, g, or t
  misc_feature (1811)..(1811): n is a, c, g, or t
  misc_feature (1815)..(1815): n is a, c, g, or t
  misc_feature (1831)..(1831): n is a, c, g, or t
  misc_feature (1838)..(1838): n is a, c, g, or t
  misc_feature (1844)..(1844): n is a, c, g, or t
  misc_feature (1849)..(1849): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732356 - DNA, 1624 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgaatctcctattccttcacacagttcaacataaagagcaataaatgttttaatgcttaa

SEQ ID NO: 732357 - DNA, 1859 bp, Homo sapiens
  misc_feature (1645)..(1645): n is a, c, g, or t
  misc_feature (1650)..(1650): n is a, c, g, or t
  misc_feature (1697)..(1697): n is a, c, g, or t
  misc_feature (1702)..(1702): n is a, c, g, or t
  misc_feature (1723)..(1723): n is a, c, g, or t
  misc_feature (1732)..(1732): n is a, c, g, or t
  misc_feature (1744)..(1744): n is a, c, g, or t
  misc_feature (1749)..(1750): n is a, c, g, or t
  misc_feature (1754)..(1754): n is a, c, g, or t
  misc_feature (1757)..(1757): n is a, c, g, or t
  misc_feature (1761)..(1761): n is a, c, g, or t
  misc_feature (1777)..(1777): n is a, c, g, or t
  misc_feature (1784)..(1784): n is a, c, g, or t
  misc_feature (1790)..(1790): n is a, c, g, or t
  misc_feature (1795)..(1795): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732358 - DNA, 1911 bp, Homo sapiens
  misc_feature (1697)..(1697): n is a, c, g, or t
  misc_feature (1702)..(1702): n is a, c, g, or t
  misc_feature (1749)..(1749): n is a, c, g, or t
  misc_feature (1754)..(1754): n is a, c, g, or t
  misc_feature (1775)..(1775): n is a, c, g, or t
  misc_feature (1784)..(1784): n is a, c, g, or t
  misc_feature (1796)..(1796): n is a, c, g, or t
  misc_feature (1801)..(1802): n is a, c, g, or t
  misc_feature (1806)..(1806): n is a, c, g, or t
  misc_feature (1809)..(1809): n is a, c, g, or t
  misc_feature (1813)..(1813): n is a, c, g, or t
  misc_feature (1829)..(1829): n is a, c, g, or t
  misc_feature (1836)..(1836): n is a, c, g, or t
  misc_feature (1842)..(1842): n is a, c, g, or t
  misc_feature (1847)..(1847): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732359 - DNA, 1622 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgaatctcctattccttcacacagttcaacataaagagcaataaatgttttaatgcttaa

SEQ ID NO: 732360 - DNA, 1857 bp, Homo sapiens
  misc_feature (1643)..(1643): n is a, c, g, or t
  misc_feature (1648)..(1648): n is a, c, g, or t
  misc_feature (1695)..(1695): n is a, c, g, or t
  misc_feature (1700)..(1700): n is a, c, g, or t
  misc_feature (1721)..(1721): n is a, c, g, or t
  misc_feature (1730)..(1730): n is a, c, g, or t
  misc_feature (1742)..(1742): n is a, c, g, or t
  misc_feature (1747)..(1748): n is a, c, g, or t
  misc_feature (1752)..(1752): n is a, c, g, or t
  misc_feature (1755)..(1755): n is a, c, g, or t
  misc_feature (1759)..(1759): n is a, c, g, or t
  misc_feature (1775)..(1775): n is a, c, g, or t
  misc_feature (1782)..(1782): n is a, c, g, or t
  misc_feature (1788)..(1788): n is a, c, g, or t
  misc_feature (1793)..(1793): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732361 - DNA, 1967 bp, Homo sapiens
  misc_feature (1753)..(1753): n is a, c, g, or t
  misc_feature (1758)..(1758): n is a, c, g, or t
  misc_feature (1805)..(1805): n is a, c, g, or t
  misc_feature (1810)..(1810): n is a, c, g, or t
  misc_feature (1831)..(1831): n is a, c, g, or t
  misc_feature (1840)..(1840): n is a, c, g, or t
  misc_feature (1852)..(1852): n is a, c, g, or t
  misc_feature (1857)..(1858): n is a, c, g, or t
  misc_feature (1862)..(1862): n is a, c, g, or t
  misc_feature (1865)..(1865): n is a, c, g, or t
  misc_feature (1869)..(1869): n is a, c, g, or t
  misc_feature (1885)..(1885): n is a, c, g, or t
  misc_feature (1892)..(1892): n is a, c, g, or t
  misc_feature (1898)..(1898): n is a, c, g, or t
  misc_feature (1903)..(1903): n is a, c, g, or t
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 732362 - DNA, 1678 bp, Homo sapiens
gtaataagggctgagacacaagccacagagcataaagctccagtccttcctccagggatgagggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgaatctcctattccttcacacagttcaacataaagagcaataaatgttttaatgcttaa

SEQ ID NO: 732363 - DNA, 1494 bp, Homo sapiens
gaccccgcgtccgctctggtgcagcatgatgctgcccccttggaccctcggccttctcctgctggccacagtcagaggaaaagaggtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaactaatcactggcacggaaccagacaccattgaggcttcaaacttccaactggaccgcaagacacgcttcatcatccatggcttcttagacaaggcggaggacagctggccatcggacatgtgcaagaaaatgtttgaagtggagaaggtgaactgcatctgtgtggactggaggcacgggtcccgggcaatgtacacccaagccgtgcaaaacattcgggttgttggggcggagacagctttcttaatacaagcactgtcgacgcagctagggtacagccttgaggacgtgcatgtcatcggccacagcctgggcgcgcacacggccgcggaggcgggcaggaggctggggggccgcgtgggcaggatcacagggctggatccagcagggccgtgcttccaggatgaacctgaggaggttcggttggatccatctgacgccgtgtttgtggatgtgattcacacagattcttctcccatagttccttccctaggtttcggaatgagccaaaaggtgggccatctggatttctttccaaatggaggaaaggaaatgcccggatgtaagaaaaatgtcctttcaaccattactgatattgatggaatatgggaaggaattggtggctttgtgtcttgcaatcacctaagaagcttcgagtattactcaagcagcgtcctcaaccctgatggcttcctgggctatccctgtgcctcctacgatgagtttcaggagagtaagtgtttcccttgtccagctgaaggatgccccaaaatggggcactatgctgaccaatttaaggggaaaacaagtgctgtggaacaaacctttttcctgaacacaggagagagtggtaactttactagttggagatataaggtatcagtcacactttctggaaaagagaaagtgaatgggtacatcaggattgctttgtatggaagtaatgaaaactcgaaacaatatgagattttcaaaggatccctcaaaccagatgcaagtcacacgtgtgctattgatgtggattttaatgttggaaaaatacagaaagttaaattcctctggaacaaacgtgggataaatctatctgagcccaaactgggggcttcccaaatcacagtgcaaagtggtgaagatgggactgagtataatttttgtagcagcgacactgtggaagaaaacgtcttgcaatctctttacccttgttaaaaacgtggtgcggctattgcggtaataaaatctttaatgcactcggtttgagggtg

SEQ ID NO: 732364 - DNA, 857 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactg

SEQ ID NO: 732365 - DNA, 1443 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 732366 - DNA, 840 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactg

SEQ ID NO: 732367 - DNA, 2061 bp, Homo sapiens
  misc_feature (1740)..(1740): n is a, c, g, or t
  misc_feature (1757)..(1757): n is a, c, g, or t
  misc_feature (1762)..(1762): n is a, c, g, or t
  misc_feature (1765)..(1765): n is a, c, g, or t
  misc_feature (1777)..(1777): n is a, c, g, or t
  misc_feature (1792)..(1792): n is a, c, g, or t
  misc_feature (1800)..(1800): n is a, c, g, or t
  misc_feature (1811)..(1811): n is a, c, g, or t
  misc_feature (1815)..(1815): n is a, c, g, or t
  misc_feature (1822)..(1822): n is a, c, g, or t
  misc_feature (1832)..(1833): n is a, c, g, or t
  misc_feature (1838)..(1838): n is a, c, g, or t
  misc_feature (1844)..(1844): n is a, c, g, or t
  misc_feature (1853)..(1853): n is a, c, g, or t
  misc_feature (1859)..(1859): n is a, c, g, or t
  misc_feature (1861)..(1862): n is a, c, g, or t
  misc_feature (1873)..(1873): n is a, c, g, or t
  misc_feature (1880)..(1880): n is a, c, g, or t
  misc_feature (1883)..(1883): n is a, c, g, or t
  misc_feature (1890)..(1890): n is a, c, g, or t
  misc_feature (1892)..(1892): n is a, c, g, or t
  misc_feature (1899)..(1899): n is a, c, g, or t
  misc_feature (1901)..(1902): n is a, c, g, or t
  misc_feature (1906)..(1907): n is a, c, g, or t
  misc_feature (1913)..(1913): n is a, c, g, or t
  misc_feature (1915)..(1916): n is a, c, g, or t
  misc_feature (1923)..(1923): n is a, c, g, or t
  misc_feature (1928)..(1929): n is a, c, g, or t
  misc_feature (1936)..(1936): n is a, c, g, or t
  misc_feature (1938)..(1938): n is a, c, g, or t
  misc_feature (1952)..(1952): n is a, c, g, or t
  misc_feature (1957)..(1957): n is a, c, g, or t
  misc_feature (1969)..(1969): n is a, c, g, or t
  misc_feature (1972)..(1972): n is a, c, g, or t
  misc_feature (1975)..(1975): n is a, c, g, or t
  misc_feature (1980)..(1981): n is a, c, g, or t
  misc_feature (1983)..(1983): n is a, c, g, or t
  misc_feature (1990)..(1990): n is a, c, g, or t
  misc_feature (2013)..(2014): n is a, c, g, or t
  misc_feature (2028)..(2028): n is a, c, g, or t
  misc_feature (2048)..(2048): n is a, c, g, or t
  misc_feature (2050)..(2050): n is a, c, g, or t
  misc_feature (2058)..(2058): n is a, c, g, or t
aatattctgcttttcctgttatgtgtttcagatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagcataggcctgtgccctgggaatggcaccacaaaggaagagaaggaaacagctgagcatgaaaacagggagctacagtcaaaggagttcctttcagcgaaggaagagacccaggggcagggcagaagcaggaactccgctccttctggagctacgctttctctcggcgctttgcctggcacctggtgtggctgtctgtgatacagttgtggcactacctcttcattggcactctcaactccttgctgccaacatggccggtgggacatggcacgagtcagcacctacacaaatgcctttgccttcactcagttcggagtgctgtgtgccccctggaatggcctgctcatggaccggcttaaacagaagtaccagaaggaagcaagaaagacagggtcttttaacatccgaggaccacattctttatactttccaaatcatcacctgccccatgcaacttacagggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaaaaaaaaaaaaaaaaaaaaaaaaaaaaaaaaaaaaaaaaaaaaaaaaaaaaaaaaaaaaaaaaaaaaaaaaaaaaaaaaaaaaaacccttgtgggccgcttggnccaagtcaattttaaantgganaangtttatgcttgnggccgaatttggggntaattggnccaattccccntatngggagcngtttaaaatnnatggnccgggntttaacaangtgggnannggaaaaccctnggggtanccnaattaantngcttggnannaaanncccttntnncaagtgnggtannaggaaangncccgaccgacgccnttccnaaagttgccccnctnaanggcanngnaaattgnaaccctaatatttgtaaaaatcnnggtaaattttggtnaacaagctatttttaaccananggccaatnggg

SEQ ID NO: 732368 - DNA, 847 bp, Homo sapiens
aaaactaccaactcacccacgtgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactg

SEQ ID NO: 732369 - DNA, 776 bp, Homo sapiens
tgtgagaggaagcaaagaaggacctgggctttgggaagatctaaagacccaggaaggtctctgggtgggataaagccaagatgaaactccccctacttctggctcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactg

SEQ ID NO: 732370 - DNA, 842 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgcgtgggttccttgcaga

SEQ ID NO: 732371 - DNA, 844 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgggatccttagatagaaaca

SEQ ID NO: 732372 - DNA, 889 bp, Homo sapiens
tctctgcaaggaacccacgcgcgtgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 732373 - DNA, 303 bp, Homo sapiens
tctctgcaaggaacccacgcgcgtgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactg

SEQ ID NO: 732374 - DNA, 288 bp, Homo sapiens
tctctgcaaggaacccacgcgcgtgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgcgtgggttccttgcaga

SEQ ID NO: 732375 - DNA, 290 bp, Homo sapiens
tctctgcaaggaacccacgcgcgtgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgggatccttagatagaaaca

SEQ ID NO: 732376 - DNA, 1284 bp, Homo sapiens
  misc_feature (963)..(963): n is a, c, g, or t
  misc_feature (980)..(980): n is a, c, g, or t
  misc_feature (985)..(985): n is a, c, g, or t
  misc_feature (988)..(988): n is a, c, g, or t
  misc_feature (1000)..(1000): n is a, c, g, or t
  misc_feature (1015)..(1015): n is a, c, g, or t
  misc_feature (1023)..(1023): n is a, c, g, or t
  misc_feature (1034)..(1034): n is a, c, g, or t
  misc_feature (1038)..(1038): n is a, c, g, or t
  misc_feature (1045)..(1045): n is a, c, g, or t
  misc_feature (1055)..(1056): n is a, c, g, or t
  misc_feature (1061)..(1061): n is a, c, g, or t
  misc_feature (1067)..(1067): n is a, c, g, or t
  misc_feature (1076)..(1076): n is a, c, g, or t
  misc_feature (1082)..(1082): n is a, c, g, or t
  misc_feature (1084)..(1085): n is a, c, g, or t
  misc_feature (1096)..(1096): n is a, c, g, or t
  misc_feature (1103)..(1103): n is a, c, g, or t
  misc_feature (1106)..(1106): n is a, c, g, or t
  misc_feature (1113)..(1113): n is a, c, g, or t
  misc_feature (1115)..(1115): n is a, c, g, or t
  misc_feature (1122)..(1122): n is a, c, g, or t
  misc_feature (1124)..(1125): n is a, c, g, or t
  misc_feature (1129)..(1130): n is a, c, g, or t
  misc_feature (1136)..(1136): n is a, c, g, or t
  misc_feature (1138)..(1139): n is a, c, g, or t
  misc_feature (1146)..(1146): n is a, c, g, or t
  misc_feature (1151)..(1152): n is a, c, g, or t
  misc_feature (1159)..(1159): n is a, c, g, or t
  misc_feature (1161)..(1161): n is a, c, g, or t
  misc_feature (1175)..(1175): n is a, c, g, or t
  misc_feature (1180)..(1180): n is a, c, g, or t
  misc_feature (1192)..(1192): n is a, c, g, or t
  misc_feature (1195)..(1195): n is a, c, g, or t
  misc_feature (1198)..(1198): n is a, c, g, or t
  misc_feature (1203)..(1204): n is a, c, g, or t
  misc_feature (1206)..(1206): n is a, c, g, or t
  misc_feature (1213)..(1213): n is a, c, g, or t
  misc_feature (1236)..(1237): n is a, c, g, or t
  misc_feature (1251)..(1251): n is a, c, g, or t
  misc_feature (1271)..(1271): n is a, c, g, or t
  misc_feature (1273)..(1273): n is a, c, g, or t
  misc_feature (1281)..(1281): n is a, c, g, or t
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaaaaaaaaaaaaaaaaaaaaaaaaaaaaaaaaaaaaaaaaaaaaaaaaaaaaaaaaaaaaaaaaaaaaaaaaaaaaaaaaaaaaaacccttgtgggccgcttggnccaagtcaattttaaantgganaangtttatgcttgnggccgaatttggggntaattggnccaattccccntatngggagcngtttaaaatnnatggnccgggntttaacaangtgggnannggaaaaccctnggggtanccnaattaantngcttggnannaaanncccttntnncaagtgnggtannaggaaangncccgaccgacgccnttccnaaagttgccccnctnaanggcanngnaaattgnaaccctaatatttgtaaaaatcnnggtaaattttggtnaacaagctatttttaaccananggccaatnggg

SEQ ID NO: 732377 - DNA, 1426 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 732378 - DNA, 1267 bp, Homo sapiens
  misc_feature (946)..(946): n is a, c, g, or t
  misc_feature (963)..(963): n is a, c, g, or t
  misc_feature (968)..(968): n is a, c, g, or t
  misc_feature (971)..(971): n is a, c, g, or t
  misc_feature (983)..(983): n is a, c, g, or t
  misc_feature (998)..(998): n is a, c, g, or t
  misc_feature (1006)..(1006): n is a, c, g, or t
  misc_feature (1017)..(1017): n is a, c, g, or t
  misc_feature (1021)..(1021): n is a, c, g, or t
  misc_feature (1028)..(1028): n is a, c, g, or t
  misc_feature (1038)..(1039): n is a, c, g, or t
  misc_feature (1044)..(1044): n is a, c, g, or t
  misc_feature (1050)..(1050): n is a, c, g, or t
  misc_feature (1059)..(1059): n is a, c, g, or t
  misc_feature (1065)..(1065): n is a, c, g, or t
  misc_feature (1067)..(1068): n is a, c, g, or t
  misc_feature (1079)..(1079): n is a, c, g, or t
  misc_feature (1086)..(1086): n is a, c, g, or t
  misc_feature (1089)..(1089): n is a, c, g, or t
  misc_feature (1096)..(1096): n is a, c, g, or t
  misc_feature (1098)..(1098): n is a, c, g, or t
  misc_feature (1105)..(1105): n is a, c, g, or t
  misc_feature (1107)..(1108): n is a, c, g, or t
  misc_feature (1112)..(1113): n is a, c, g, or t
  misc_feature (1119)..(1119): n is a, c, g, or t
  misc_feature (1121)..(1122): n is a, c, g, or t
  misc_feature (1129)..(1129): n is a, c, g, or t
  misc_feature (1134)..(1135): n is a, c, g, or t
  misc_feature (1142)..(1142): n is a, c, g, or t
  misc_feature (1144)..(1144): n is a, c, g, or t
  misc_feature (1158)..(1158): n is a, c, g, or t
  misc_feature (1163)..(1163): n is a, c, g, or t
  misc_feature (1175)..(1175): n is a, c, g, or t
  misc_feature (1178)..(1178): n is a, c, g, or t
  misc_feature (1181)..(1181): n is a, c, g, or t
  misc_feature (1186)..(1187): n is a, c, g, or t
  misc_feature (1189)..(1189): n is a, c, g, or t
  misc_feature (1196)..(1196): n is a, c, g, or t
  misc_feature (1219)..(1220): n is a, c, g, or t
  misc_feature (1234)..(1234): n is a, c, g, or t
  misc_feature (1254)..(1254): n is a, c, g, or t
  misc_feature (1256)..(1256): n is a, c, g, or t
  misc_feature (1264)..(1264): n is a, c, g, or t
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaaaaaaaaaaaaaaaaaaaaaaaaaaaaaaaaaaaaaaaaaaaaaaaaaaaaaaaaaaaaaaaaaaaaaaaaaaaaaaaaaaaaaacccttgtgggccgcttggnccaagtcaattttaaantgganaangtttatgcttgnggccgaatttggggntaattggnccaattccccntatngggagcngtttaaaatnnatggnccgggntttaacaangtgggnannggaaaaccctnggggtanccnaattaantngcttggnannaaanncccttntnncaagtgnggtannaggaaangncccgaccgacgccnttccnaaagttgccccnctnaanggcanngnaaattgnaaccctaatatttgtaaaaatcnnggtaaattttggtnaacaagctatttttaaccananggccaatnggg

SEQ ID NO: 732379 - DNA, 825 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgcgtgggttccttgcaga

SEQ ID NO: 732380 - DNA, 827 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgggatccttagatagaaaca

SEQ ID NO: 732381 - DNA, 1389 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagttcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 732382 - DNA, 1230 bp, Homo sapiens
  misc_feature (909)..(909): n is a, c, g, or t
  misc_feature (926)..(926): n is a, c, g, or t
  misc_feature (931)..(931): n is a, c, g, or t
  misc_feature (934)..(934): n is a, c, g, or t
  misc_feature (946)..(946): n is a, c, g, or t
  misc_feature (961)..(961): n is a, c, g, or t
  misc_feature (969)..(969): n is a, c, g, or t
  misc_feature (980)..(980): n is a, c, g, or t
  misc_feature (984)..(984): n is a, c, g, or t
  misc_feature (991)..(991): n is a, c, g, or t
  misc_feature (1001)..(1002): n is a, c, g, or t
  misc_feature (1007)..(1007): n is a, c, g, or t
  misc_feature (1013)..(1013): n is a, c, g, or t
  misc_feature (1022)..(1022): n is a, c, g, or t
  misc_feature (1028)..(1028): n is a, c, g, or t
  misc_feature (1030)..(1031): n is a, c, g, or t
  misc_feature (1042)..(1042): n is a, c, g, or t
  misc_feature (1049)..(1049): n is a, c, g, or t
  misc_feature (1052)..(1052): n is a, c, g, or t
  misc_feature (1059)..(1059): n is a, c, g, or t
  misc_feature (1061)..(1061): n is a, c, g, or t
  misc_feature (1068)..(1068): n is a, c, g, or t
  misc_feature (1070)..(1071): n is a, c, g, or t
  misc_feature (1075)..(1076): n is a, c, g, or t
  misc_feature (1082)..(1082): n is a, c, g, or t
  misc_feature (1084)..(1085): n is a, c, g, or t
  misc_feature (1092)..(1092): n is a, c, g, or t
  misc_feature (1097)..(1098): n is a, c, g, or t
  misc_feature (1105)..(1105): n is a, c, g, or t
  misc_feature (1107)..(1107): n is a, c, g, or t
  misc_feature (1121)..(1121): n is a, c, g, or t
  misc_feature (1126)..(1126): n is a, c, g, or t
  misc_feature (1138)..(1138): n is a, c, g, or t
  misc_feature (1141)..(1141): n is a, c, g, or t
  misc_feature (1144)..(1144): n is a, c, g, or t
  misc_feature (1149)..(1150): n is a, c, g, or t
  misc_feature (1152)..(1152): n is a, c, g, or t
  misc_feature (1159)..(1159): n is a, c, g, or t
  misc_feature (1182)..(1183): n is a, c, g, or t
  misc_feature (1197)..(1197): n is a, c, g, or t
  misc_feature (1217)..(1217): n is a, c, g, or t
  misc_feature (1219)..(1219): n is a, c, g, or t
  misc_feature (1227)..(1227): n is a, c, g, or t
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagttcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaaaaaaaaaaaaaaaaaaaaaaaaaaaaaaaaaaaaaaaaaaaaaaaaaaaaaaaaaaaaaaaaaaaaaaaaaaaaaaaaaaaaaacccttgtgggccgcttggnccaagtcaattttaaantgganaangtttatgcttgnggccgaatttggggntaattggnccaattccccntatngggagcngtttaaaatnnatggnccgggntttaacaangtgggnannggaaaaccctnggggtanccnaattaantngcttggnannaaanncccttntnncaagtgnggtannaggaaangncccgaccgacgccnttccnaaagttgccccnctnaanggcanngnaaattgnaaccctaatatttgtaaaaatcnnggtaaattttggtnaacaagctatttttaaccananggccaatnggg

SEQ ID NO: 732383 - DNA, 803 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagttcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactg

SEQ ID NO: 732384 - DNA, 788 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagttcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgcgtgggttccttgcaga

SEQ ID NO: 732385 - DNA, 790 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagttcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgggatccttagatagaaaca

SEQ ID NO: 732386 - DNA, 1422 bp, Homo sapiens
ccatcttcaccctcatcaaaggctcccttcagaatgacccattttacgataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 732387 - DNA, 1263 bp, Homo sapiens
  misc_feature (942)..(942): n is a, c, g, or t
  misc_feature (959)..(959): n is a, c, g, or t
  misc_feature (964)..(964): n is a, c, g, or t
  misc_feature (967)..(967): n is a, c, g, or t
  misc_feature (979)..(979): n is a, c, g, or t
  misc_feature (994)..(994): n is a, c, g, or t
  misc_feature (1002)..(1002): n is a, c, g, or t
  misc_feature (1013)..(1013): n is a, c, g, or t
  misc_feature (1017)..(1017): n is a, c, g, or t
  misc_feature (1024)..(1024): n is a, c, g, or t
  misc_feature (1034)..(1035): n is a, c, g, or t
  misc_feature (1040)..(1040): n is a, c, g, or t
  misc_feature (1046)..(1046): n is a, c, g, or t
  misc_feature (1055)..(1055): n is a, c, g, or t
  misc_feature (1061)..(1061): n is a, c, g, or t
  misc_feature (1063)..(1064): n is a, c, g, or t
  misc_feature (1075)..(1075): n is a, c, g, or t
  misc_feature (1082)..(1082): n is a, c, g, or t
  misc_feature (1085)..(1085): n is a, c, g, or t
  misc_feature (1092)..(1092): n is a, c, g, or t
  misc_feature (1094)..(1094): n is a, c, g, or t
  misc_feature (1101)..(1101): n is a, c, g, or t
  misc_feature (1103)..(1104): n is a, c, g, or t
  misc_feature (1108)..(1109): n is a, c, g, or t
  misc_feature (1115)..(1115): n is a, c, g, or t
  misc_feature (1117)..(1118): n is a, c, g, or t
  misc_feature (1125)..(1125): n is a, c, g, or t
  misc_feature (1130)..(1131): n is a, c, g, or t
  misc_feature (1138)..(1138): n is a, c, g, or t
  misc_feature (1140)..(1140): n is a, c, g, or t
  misc_feature (1154)..(1154): n is a, c, g, or t
  misc_feature (1159)..(1159): n is a, c, g, or t
  misc_feature (1171)..(1171): n is a, c, g, or t
  misc_feature (1174)..(1174): n is a, c, g, or t
  misc_feature (1177)..(1177): n is a, c, g, or t
  misc_feature (1182)..(1183): n is a, c, g, or t
  misc_feature (1185)..(1185): n is a, c, g, or t
  misc_feature (1192)..(1192): n is a, c, g, or t
  misc_feature (1215)..(1216): n is a, c, g, or t
  misc_feature (1230)..(1230): n is a, c, g, or t
  misc_feature (1250)..(1250): n is a, c, g, or t
  misc_feature (1252)..(1252): n is a, c, g, or t
  misc_feature (1260)..(1260): n is a, c, g, or t
ccatcttcaccctcatcaaaggctcccttcagaatgacccattttacgataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaaaaaaaaaaaaaaaaaaaaaaaaaaaaaaaaaaaaaaaaaaaaaaaaaaaaaaaaaaaaaaaaaaaaaaaaaaaaaaaaaaaaaacccttgtgggccgcttggnccaagtcaattttaaantgganaangtttatgcttgnggccgaatttggggntaattggnccaattccccntatngggagcngtttaaaatnnatggnccgggntttaacaangtgggnannggaaaaccctnggggtanccnaattaantngcttggnannaaanncccttntnncaagtgnggtannaggaaangncccgaccgacgccnttccnaaagttgccccnctnaanggcanngnaaattgnaaccctaatatttgtaaaaatcnnggtaaattttggtnaacaagctatttttaaccananggccaatnggg

SEQ ID NO: 732388 - DNA, 836 bp, Homo sapiens
ccatcttcaccctcatcaaaggctcccttcagaatgacccattttacgataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactg

SEQ ID NO: 732389 - DNA, 821 bp, Homo sapiens
ccatcttcaccctcatcaaaggctcccttcagaatgacccattttacgataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgcgtgggttccttgcaga

SEQ ID NO: 732390 - DNA, 823 bp, Homo sapiens
ccatcttcaccctcatcaaaggctcccttcagaatgacccattttacgataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgggatccttagatagaaaca

SEQ ID NO: 732391 - DNA, 1294 bp, Homo sapiens
tgtgagaggaagcaaagaaggacctgggctttgggaagatctaaagacccaggaaggtctctgggtgggataaagccaagatgaaactccccctacttctggctcgagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 732392 - DNA, 1135 bp, Homo sapiens
  misc_feature (814)..(814): n is a, c, g, or t
  misc_feature (831)..(831): n is a, c, g, or t
  misc_feature (836)..(836): n is a, c, g, or t
  misc_feature (839)..(839): n is a, c, g, or t
  misc_feature (851)..(851): n is a, c, g, or t
  misc_feature (866)..(866): n is a, c, g, or t
  misc_feature (874)..(874): n is a, c, g, or t
  misc_feature (885)..(885): n is a, c, g, or t
  misc_feature (889)..(889): n is a, c, g, or t
  misc_feature (896)..(896): n is a, c, g, or t
  misc_feature (906)..(907): n is a, c, g, or t
  misc_feature (912)..(912): n is a, c, g, or t
  misc_feature (918)..(918): n is a, c, g, or t
  misc_feature (927)..(927): n is a, c, g, or t
  misc_feature (933)..(933): n is a, c, g, or t
  misc_feature (935)..(936): n is a, c, g, or t
  misc_feature (947)..(947): n is a, c, g, or t
  misc_feature (954)..(954): n is a, c, g, or t
  misc_feature (957)..(957): n is a, c, g, or t
  misc_feature (964)..(964): n is a, c, g, or t
  misc_feature (966)..(966): n is a, c, g, or t
  misc_feature (973)..(973): n is a, c, g, or t
  misc_feature (975)..(976): n is a, c, g, or t
  misc_feature (980)..(981): n is a, c, g, or t
  misc_feature (987)..(987): n is a, c, g, or t
  misc_feature (989)..(990): n is a, c, g, or t
  misc_feature (997)..(997): n is a, c, g, or t
  misc_feature (1002)..(1003): n is a, c, g, or t
  misc_feature (1010)..(1010): n is a, c, g, or t
  misc_feature (1012)..(1012): n is a, c, g, or t
  misc_feature (1026)..(1026): n is a, c, g, or t
  misc_feature (1031)..(1031): n is a, c, g, or t
  misc_feature (1043)..(1043): n is a, c, g, or t
  misc_feature (1046)..(1046): n is a, c, g, or t
  misc_feature (1049)..(1049): n is a, c, g, or t
  misc_feature (1054)..(1055): n is a, c, g, or t
  misc_feature (1057)..(1057): n is a, c, g, or t
  misc_feature (1064)..(1064): n is a, c, g, or t
  misc_feature (1087)..(1088): n is a, c, g, or t
  misc_feature (1102)..(1102): n is a, c, g, or t
  misc_feature (1122)..(1122): n is a, c, g, or t
  misc_feature (1124)..(1124): n is a, c, g, or t
  misc_feature (1132)..(1132): n is a, c, g, or t
tgtgagaggaagcaaagaaggacctgggctttgggaagatctaaagacccaggaaggtctctgggtgggataaagccaagatgaaactccccctacttctggctcgagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaaaaaaaaaaaaaaaaaaaaaaaaaaaaaaaaaaaaaaaaaaaaaaaaaaaaaaaaaaaaaaaaaaaaaaaaaaaaaaaaaaaaaacccttgtgggccgcttggnccaagtcaattttaaantgganaangtttatgcttgnggccgaatttggggntaattggnccaattccccntatngggagcngtttaaaatnnatggnccgggntttaacaangtgggnannggaaaaccctnggggtanccnaattaantngcttggnannaaanncccttntnncaagtgnggtannaggaaangncccgaccgacgccnttccnaaagttgccccnctnaanggcanngnaaattgnaaccctaatatttgtaaaaatcnnggtaaattttggtnaacaagctatttttaaccananggccaatnggg

SEQ ID NO: 732393 - DNA, 708 bp, Homo sapiens
tgtgagaggaagcaaagaaggacctgggctttgggaagatctaaagacccaggaaggtctctgggtgggataaagccaagatgaaactccccctacttctggctcgagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactg

SEQ ID NO: 732394 - DNA, 693 bp, Homo sapiens
tgtgagaggaagcaaagaaggacctgggctttgggaagatctaaagacccaggaaggtctctgggtgggataaagccaagatgaaactccccctacttctggctcgagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgcgtgggttccttgcaga

SEQ ID NO: 732395 - DNA, 695 bp, Homo sapiens
tgtgagaggaagcaaagaaggacctgggctttgggaagatctaaagacccaggaaggtctctgggtgggataaagccaagatgaaactccccctacttctggctcgagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgggatccttagatagaaaca

SEQ ID NO: 732396 - DNA, 1556 bp, Homo sapiens
tgtgagaggaagcaaagaaggacctgggctttgggaagatctaaagacccaggaaggtctctgggtgggtgagtgctttctctgctgtggtggagctggtgacagtttattctcccaggaggtccctggctgtggctgacagtttctggagggctggcaggcgtctacctgtggctttcaggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 732397 - DNA, 1397 bp, Homo sapiens
  misc_feature (1076)..(1076): n is a, c, g, or t
  misc_feature (1093)..(1093): n is a, c, g, or t
  misc_feature (1098)..(1098): n is a, c, g, or t
  misc_feature (1101)..(1101): n is a, c, g, or t
  misc_feature (1113)..(1113): n is a, c, g, or t
  misc_feature (1128)..(1128): n is a, c, g, or t
  misc_feature (1136)..(1136): n is a, c, g, or t
  misc_feature (1147)..(1147): n is a, c, g, or t
  misc_feature (1151)..(1151): n is a, c, g, or t
  misc_feature (1158)..(1158): n is a, c, g, or t
  misc_feature (1168)..(1169): n is a, c, g, or t
  misc_feature (1174)..(1174): n is a, c, g, or t
  misc_feature (1180)..(1180): n is a, c, g, or t
  misc_feature (1189)..(1189): n is a, c, g, or t
  misc_feature (1195)..(1195): n is a, c, g, or t
  misc_feature (1197)..(1198): n is a, c, g, or t
  misc_feature (1209)..(1209): n is a, c, g, or t
  misc_feature (1216)..(1216): n is a, c, g, or t
  misc_feature (1219)..(1219): n is a, c, g, or t
  misc_feature (1226)..(1226): n is a, c, g, or t
  misc_feature (1228)..(1228): n is a, c, g, or t
  misc_feature (1235)..(1235): n is a, c, g, or t
  misc_feature (1237)..(1238): n is a, c, g, or t
  misc_feature (1242)..(1243): n is a, c, g, or t
  misc_feature (1249)..(1249): n is a, c, g, or t
  misc_feature (1251)..(1252): n is a, c, g, or t
  misc_feature (1259)..(1259): n is a, c, g, or t
  misc_feature (1264)..(1265): n is a, c, g, or t
  misc_feature (1272)..(1272): n is a, c, g, or t
  misc_feature (1274)..(1274): n is a, c, g, or t
  misc_feature (1288)..(1288): n is a, c, g, or t
  misc_feature (1293)..(1293): n is a, c, g, or t
  misc_feature (1305)..(1305): n is a, c, g, or t
  misc_feature (1308)..(1308): n is a, c, g, or t
  misc_feature (1311)..(1311): n is a, c, g, or t
  misc_feature (1316)..(1317): n is a, c, g, or t
  misc_feature (1319)..(1319): n is a, c, g, or t
  misc_feature (1326)..(1326): n is a, c, g, or t
  misc_feature (1349)..(1350): n is a, c, g, or t
  misc_feature (1364)..(1364): n is a, c, g, or t
  misc_feature (1384)..(1384): n is a, c, g, or t
  misc_feature (1386)..(1386): n is a, c, g, or t
  misc_feature (1394)..(1394): n is a, c, g, or t
tgtgagaggaagcaaagaaggacctgggctttgggaagatctaaagacccaggaaggtctctgggtgggtgagtgctttctctgctgtggtggagctggtgacagtttattctcccaggaggtccctggctgtggctgacagtttctggagggctggcaggcgtctacctgtggctttcaggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaaaaaaaaaaaaaaaaaaaaaaaaaaaaaaaaaaaaaaaaaaaaaaaaaaaaaaaaaaaaaaaaaaaaaaaaaaaaaaaaaaaaaacccttgtgggccgcttggnccaagtcaattttaaantgganaangtttatgcttgnggccgaatttggggntaattggnccaattccccntatngggagcngtttaaaatnnatggnccgggntttaacaangtgggnannggaaaaccctnggggtanccnaattaantngcttggnannaaanncccttntnncaagtgnggtannaggaaangncccgaccgacgccnttccnaaagttgccccnctnaanggcanngnaaattgnaaccctaatatttgtaaaaatcnnggtaaattttggtnaacaagctatttttaaccananggccaatnggg

SEQ ID NO: 732398 - DNA, 970 bp, Homo sapiens
tgtgagaggaagcaaagaaggacctgggctttgggaagatctaaagacccaggaaggtctctgggtgggtgagtgctttctctgctgtggtggagctggtgacagtttattctcccaggaggtccctggctgtggctgacagtttctggagggctggcaggcgtctacctgtggctttcaggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactg

SEQ ID NO: 732399 - DNA, 955 bp, Homo sapiens
tgtgagaggaagcaaagaaggacctgggctttgggaagatctaaagacccaggaaggtctctgggtgggtgagtgctttctctgctgtggtggagctggtgacagtttattctcccaggaggtccctggctgtggctgacagtttctggagggctggcaggcgtctacctgtggctttcaggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgcgtgggttccttgcaga

SEQ ID NO: 732400 - DNA, 957 bp, Homo sapiens
tgtgagaggaagcaaagaaggacctgggctttgggaagatctaaagacccaggaaggtctctgggtgggtgagtgctttctctgctgtggtggagctggtgacagtttattctcccaggaggtccctggctgtggctgacagtttctggagggctggcaggcgtctacctgtggctttcaggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgggatccttagatagaaaca

SEQ ID NO: 732401 - DNA, 1317 bp, Homo sapiens
gataaagccaagatgaaactccccctacttctggctcccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 732402 - DNA, 1158 bp, Homo sapiens
  misc_feature (837)..(837): n is a, c, g, or t
  misc_feature (854)..(854): n is a, c, g, or t
  misc_feature (859)..(859): n is a, c, g, or t
  misc_feature (862)..(862): n is a, c, g, or t
  misc_feature (874)..(874): n is a, c, g, or t
  misc_feature (889)..(889): n is a, c, g, or t
  misc_feature (897)..(897): n is a, c, g, or t
  misc_feature (908)..(908): n is a, c, g, or t
  misc_feature (912)..(912): n is a, c, g, or t
  misc_feature (919)..(919): n is a, c, g, or t
  misc_feature (929)..(930): n is a, c, g, or t
  misc_feature (935)..(935): n is a, c, g, or t
  misc_feature (941)..(941): n is a, c, g, or t
  misc_feature (950)..(950): n is a, c, g, or t
  misc_feature (956)..(956): n is a, c, g, or t
  misc_feature (958)..(959): n is a, c, g, or t
  misc_feature (970)..(970): n is a, c, g, or t
  misc_feature (977)..(977): n is a, c, g, or t
  misc_feature (980)..(980): n is a, c, g, or t
  misc_feature (987)..(987): n is a, c, g, or t
  misc_feature (989)..(989): n is a, c, g, or t
  misc_feature (996)..(996): n is a, c, g, or t
  misc_feature (998)..(999): n is a, c, g, or t
  misc_feature (1003)..(1004): n is a, c, g, or t
  misc_feature (1010)..(1010): n is a, c, g, or t
  misc_feature (1012)..(1013): n is a, c, g, or t
  misc_feature (1020)..(1020): n is a, c, g, or t
  misc_feature (1025)..(1026): n is a, c, g, or t
  misc_feature (1033)..(1033): n is a, c, g, or t
  misc_feature (1035)..(1035): n is a, c, g, or t
  misc_feature (1049)..(1049): n is a, c, g, or t
  misc_feature (1054)..(1054): n is a, c, g, or t
  misc_feature (1066)..(1066): n is a, c, g, or t
  misc_feature (1069)..(1069): n is a, c, g, or t
  misc_feature (1072)..(1072): n is a, c, g, or t
  misc_feature (1077)..(1078): n is a, c, g, or t
  misc_feature (1080)..(1080): n is a, c, g, or t
  misc_feature (1087)..(1087): n is a, c, g, or t
  misc_feature (1110)..(1111): n is a, c, g, or t
  misc_feature (1125)..(1125): n is a, c, g, or t
  misc_feature (1145)..(1145): n is a, c, g, or t
  misc_feature (1147)..(1147): n is a, c, g, or t
  misc_feature (1155)..(1155): n is a, c, g, or t
gataaagccaagatgaaactccccctacttctggctcccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaaaaaaaaaaaaaaaaaaaaaaaaaaaaaaaaaaaaaaaaaaaaaaaaaaaaaaaaaaaaaaaaaaaaaaaaaaaaaaaaaaaaaacccttgtgggccgcttggnccaagtcaattttaaantgganaangtttatgcttgnggccgaatttggggntaattggnccaattccccntatngggagcngtttaaaatnnatggnccgggntttaacaangtgggnannggaaaaccctnggggtanccnaattaantngcttggnannaaanncccttntnncaagtgnggtannaggaaangncccgaccgacgccnttccnaaagttgccccnctnaanggcanngnaaattgnaaccctaatatttgtaaaaatcnnggtaaattttggtnaacaagctatttttaaccananggccaatnggg

SEQ ID NO: 732403 - DNA, 731 bp, Homo sapiens
gataaagccaagatgaaactccccctacttctggctcccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactg

SEQ ID NO: 732404 - DNA, 716 bp, Homo sapiens
gataaagccaagatgaaactccccctacttctggctcccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgcgtgggttccttgcaga

SEQ ID NO: 732405 - DNA, 718 bp, Homo sapiens
gataaagccaagatgaaactccccctacttctggctcccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggttttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgggatccttagatagaaaca

SEQ ID NO: 732406 - DNA, 483 bp, Homo sapiens
tgaattcatgtaggaaggatgctccattctttgtcttttatcctgccctgtagtttacttgccggaggtgctacaggggcaacctggttttccatccacaacttcaatattaattatcgaatccagtgttctgtcagcgcgctcaaccagggtcaagtctggattggaggcaggatcacaggctcggtaagagaagtgtgaacactaaatggggtgcacctgctgatctcagccagcactcagcttgcatcagatttgtctgtttttctcctgtataatctccagaagaaccagggatagatggacacccacagacaacactgagggggctgcctgggcattcagggaagagctaaggatttagaatcaggaggtttgggtccaagttcctttccatctctcactatctatgtaacttaagttagctgggcatggtggtgcatgtctgtaatcctagctacttgggaggctgaggcaggagag

SEQ ID NO: 732407 - DNA, 757 bp, Homo sapiens
  misc_feature (47)..(47): n is a, c, g, or t
  misc_feature (503)..(503): n is a, c, g, or t
  misc_feature (524)..(524): n is a, c, g, or t
acactgtcctttggccaccggacatcatgcctcccaagaaggatgtncccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttcctgcccatgctccaggcagtggccaagaaccgaggccaaggcacatatgaggactacttggaggggtttcgtgtgtttgacaaggaggggaacggnaaagtcatgggagcagagctnagacatgttctcaccacccttggagagaagatgactgaggaggaggtggagaccgttctggcaggacacgaggacagcaacggctgcatcaactacgaggccttcttgaaacacatcctaagcgtctgagtgctgcagatccagtggggtccggacactgggccccgcaggcgaaagcacgttccagccaccaggaggccacctattgtttcaaaataaagactgggttcctc

SEQ ID NO: 732408 - DNA, 1135 bp, Homo sapiens
gagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgta

SEQ ID NO: 732409 - DNA, 15730 bp, Homo sapiens
  misc_feature (12274)..(12274): n is a, c, g, or t
  misc_feature (12366)..(12366): n is a, c, g, or t
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 732410 - DNA, 3809 bp, Homo sapiens
acgcatcacctaaatctattgctgttctatgatttcccccttatgtcactcatcaccacaatgacacccccttacaatcaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 732411 - DNA, 308 bp, Homo sapiens
ggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgaagacgaccgcgtcccggcctgcggcggccggggtgggagcccagccctctggagagcccgccgtcccaaagcacag

SEQ ID NO: 732412 - DNA, 8959 bp, Homo sapiens
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 732413 - DNA, 10042 bp, Homo sapiens
  misc_feature (6586)..(6586): n is a, c, g, or t
  misc_feature (6678)..(6678): n is a, c, g, or t
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 732414 - DNA, 9811 bp, Homo sapiens
  misc_feature (6586)..(6586): n is a, c, g, or t
  misc_feature (6678)..(6678): n is a, c, g, or t
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 732415 - DNA, 9625 bp, Homo sapiens
  misc_feature (6586)..(6586): n is a, c, g, or t
  misc_feature (6678)..(6678): n is a, c, g, or t
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccaggtgcctgctctacaagtccccgtcacccgagagtttgttcccgttgcaccacggccctgtaatgcgtatta

SEQ ID NO: 732416 - DNA, 7587 bp, Homo sapiens
  misc_feature (6586)..(6586): n is a, c, g, or t
  misc_feature (6678)..(6678): n is a, c, g, or t
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccaacgttgggcctcacggtggcctctccaagctcagctcctgccctccaatggcatctgcaggccccaaatggtctccagtcgtggatatca

SEQ ID NO: 732417 - DNA, 3608 bp, Homo sapiens
caaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 732418 - DNA, 3377 bp, Homo sapiens
caaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 732419 - DNA, 3191 bp, Homo sapiens
caaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccaggtgcctgctctacaagtccccgtcacccgagagtttgttcccgttgcaccacggccctgtaatgcgtatta

SEQ ID NO: 732420 - DNA, 3370 bp, Homo sapiens
acgcatcacctaaatctattgctgttctatgatttcccccttatgtcactcatcaccacaatgacacccccttacaatcaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 732421 - DNA, 3139 bp, Homo sapiens
acgcatcacctaaatctattgctgttctatgatttcccccttatgtcactcatcaccacaatgacacccccttacaatcaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 732422 - DNA, 2953 bp, Homo sapiens
acgcatcacctaaatctattgctgttctatgatttcccccttatgtcactcatcaccacaatgacacccccttacaatcaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccaggtgcctgctctacaagtccccgtcacccgagagtttgttcccgttgcaccacggccctgtaatgcgtatta

SEQ ID NO: 732423 - DNA, 4892 bp, Homo sapiens; identical to SEQ ID NO: 488739
  misc_feature (1436)..(1436): n is a, c, g, or t
  misc_feature (1528)..(1528): n is a, c, g, or t

SEQ ID NO: 732424 - DNA, 4661 bp, Homo sapiens
  misc_feature (1436)..(1436): n is a, c, g, or t
  misc_feature (1528)..(1528): n is a, c, g, or t
acgcatcacctaaatctattgctgttctatgatttcccccttatgtcactcatcaccacaatgacacccccttacaatcaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 732425 - DNA, 4475 bp, Homo sapiens
  misc_feature (1436)..(1436): n is a, c, g, or t
  misc_feature (1528)..(1528): n is a, c, g, or t
acgcatcacctaaatctattgctgttctatgatttcccccttatgtcactcatcaccacaatgacacccccttacaatcaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccaggtgcctgctctacaagtccccgtcacccgagagtttgttcccgttgcaccacggccctgtaatgcgtatta

SEQ ID NO: 732426 - DNA, 2437 bp, Homo sapiens
  misc_feature (1436)..(1436): n is a, c, g, or t
  misc_feature (1528)..(1528): n is a, c, g, or t
acgcatcacctaaatctattgctgttctatgatttcccccttatgtcactcatcaccacaatgacacccccttacaatcaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccaacgttgggcctcacggtggcctctccaagctcagctcctgccctccaatggcatctgcaggccccaaatggtctccagtcgtggatatca

SEQ ID NO: 732427 - DNA, 2328 bp, Homo sapiens; identical to SEQ ID NO: 488751
  misc_feature (81)..(81): n is a, c, g, or t
  misc_feature (95)..(95): n is a, c, g, or t
  misc_feature (147)..(147): n is a, c, g, or t

SEQ ID NO: 732428 - DNA, 2097 bp, Homo sapiens
  misc_feature (81)..(81): n is a, c, g, or t
  misc_feature (95)..(95): n is a, c, g, or t
  misc_feature (147)..(147): n is a, c, g, or t
gtagtagctctcgttcaggacacagcagataagcacagaggaaggttagggcctcaggcctgtggtcctgatgatgttggntgtgaagagtgggntcggcgtggggatccaggcaccggtggtggtcgtctgcacagtgctggggtngggggctgaagatgacccagtcgtgtacccgcgagtgggacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 732429 - DNA, 1911 bp, Homo sapiens
  misc_feature (81)..(81): n is a, c, g, or t
  misc_feature (95)..(95): n is a, c, g, or t
  misc_feature (147)..(147): n is a, c, g, or t
gtagtagctctcgttcaggacacagcagataagcacagaggaaggttagggcctcaggcctgtggtcctgatgatgttggntgtgaagagtgggntcggcgtggggatccaggcaccggtggtggtcgtctgcacagtgctggggtngggggctgaagatgacccagtcgtgtacccgcgagtgggacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccaggtgcctgctctacaagtccccgtcacccgagagtttgttcccgttgcaccacggccctgtaatgcgtatta

SEQ ID NO: 732430 - DNA, 1615 bp, Homo sapiens
  misc_feature (1602)..(1602): n is a, c, g, or t
  misc_feature (1605)..(1605): n is a, c, g, or t
cagtagtccttggggcggaactggccccccgtggcccggcccggctcggccccacctccgcccgcaggcggtcccggcccacgcgggaaggtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagccgcagctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagctgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgggctccgggagcgaattacaagcgcgcacctgcancgncaaaaaaaaa

SEQ ID NO: 732431 - DNA, 1631 bp, Homo sapiens
  misc_feature (2)..(2): n is a, c, g, or t
  misc_feature (278)..(278): n is a, c, g, or t
  misc_feature (1618)..(1618): n is a, c, g, or t
  misc_feature (1621)..(1621): n is a, c, g, or t
gngacacaaaagaacaagatgaaaaaaagaggcaggaaccggaccggaaaacccgggaacggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacccgtggctgacgtcattgcagaggactnggtcctgtccatggagcagatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagccgcagctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagctgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgggctccgggagcgaattacaagcgcgcacctgcancgncaaaaaaaaa

SEQ ID NO: 732432 - DNA, 2433 bp, Homo sapiens
  misc_feature (2)..(2): n is a, c, g, or t
  misc_feature (278)..(278): n is a, c, g, or t
gngacacaaaagaacaagatgaaaaaaagaggcaggaaccggaccggaaaacccgggaacggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacccgtggctgacgtcattgcagaggactnggtcctgtccatggagcagatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagccgcagctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagctgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccaccccttctgtcgtcttcttgtcagcctgggacatcagcagacgcttgatgtactccttgttgattttccctttcccgtccgggtccagcatcttgaaggcgttaagaatggtctcctcggcgtcggtaccgctcagcttctccccaaacaggttcagaaacatggtgaagttgatgggccccgaggcctctttgagcatggcgtccagctcgtcgtccttgacgttggtcttgcccagggaggcataggtgtccttcaggtcctccttgtcaatgaagccatctcggttctgatccatgagtgtgaatgcctccttgaactcctggatctgagtctgctcaaagttggagaagacattggatgaggctctctgggcccggagggcacccccttccttcttcttggtcttcctgctggccatgcctgcttctgcctgctttgatgcgtctgcccagggccccaggtcttgcccatcttaagctcctgcttggtcccccaggacagttcagactccggctgccactccctacaaggacaggcttggggctaccccaggggactggacagctgcagagtgagctttggcagcctggcagtgactcacacccttgccctgcctcaccccgcaaggcccccagcctccccagatacctctggccaggactacctcccatccacctgtccccgaaccccggggaggctttgttctcccaaggattctgtgtgtcagcagggccacctgtacacgctcttggctgggggcctgggcaccctggaactgcaggagccagaggaaggggcactttttctagatttgcacaacgctgctgtgggtgactgcagctggtcaccgggcttctgccaagcacactctgtctgtc

SEQ ID NO: 732433 - DNA, 1600 bp, Homo sapiens
  misc_feature (2)..(2): n is a, c, g, or t
  misc_feature (278)..(278): n is a, c, g, or t
gngacacaaaagaacaagatgaaaaaaagaggcaggaaccggaccggaaaacccgggaacggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacccgtggctgacgtcattgcagaggactnggtcctgtccatggagcagatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagccgcagctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagctgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccaccccttctgtcgtcttctaacagccgtatagtagtagtaggcggccgc

SEQ ID NO: 732434 - DNA, 1932 bp, Homo sapiens
  misc_feature (2)..(2): n is a, c, g, or t
  misc_feature (278)..(278): n is a, c, g, or t
gngacacaaaagaacaagatgaaaaaaagaggcaggaaccggaccggaaaacccgggaacggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacccgtggctgacgtcattgcagaggactnggtcctgtccatggagcagatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagccgcagctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagctgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgtcagcctgggacatcagcagacgcttgatgctgaggacgaggaaaggggtcagcgcgggctgatgcgggggtgcaggagccttctcggtggggctcaggtgctccaggggccccaggttgtactcgctcactgcactcccgcccttcccgctggagtgtggccctggggcaggtcccttcccaacacacactcaggggccatcacttctgggggagccgctgatggggacagagccggaaggaggttacaggccagcgcctggtactttccccggcgcctagcaggagctgaagatggaggagtgggctgaggggaagccgccccacccccaccgggcacaggcgctggtccctgtgtgagcagggctggcctccc

SEQ ID NO: 732435 - DNA, 2417 bp, Homo sapiens
  misc_feature (2)..(2): n is a, c, g, or t
  misc_feature (278)..(278): n is a, c, g, or t
gngacacaaaagaacaagatgaaaaaaagaggcaggaaccggaccggaaaacccgggaacggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacccgtggctgacgtcattgcagaggactnggtcctgtccatggagcagatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagccgcagctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagctgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgtcagcctgggacatcagcagacgcttgatgtactccttgttgattttccctttcccgtccgggtccagcatcttgaaggcgttaagaatggtctcctcggcgtcggtaccgctcagcttctccccaaacaggttcagaaacatggtgaagttgatgggccccgaggcctctttgagcatggcgtccagctcgtcgtccttgacgttggtcttgcccagggaggcataggtgtccttcaggtcctccttgtcaatgaagccatctcggttctgatccatgagtgtgaatgcctccttgaactcctggatctgagtctgctcaaagttggagaagacattggatgaggctctctgggcccggagggcacccccttccttcttcttggtcttcctgctggccatgcctgcttctgcctgctttgatgcgtctgcccagggccccaggtcttgcccatcttaagctcctgcttggtcccccaggacagttcagactccggctgccactccctacaaggacaggcttggggctaccccaggggactggacagctgcagagtgagctttggcagcctggcagtgactcacacccttgccctgcctcaccccgcaaggcccccagcctccccagatacctctggccaggactacctcccatccacctgtccccgaaccccggggaggctttgttctcccaaggattctgtgtgtcagcagggccacctgtacacgctcttggctgggggcctgggcaccctggaactgcaggagccagaggaaggggcactttttctagatttgcacaacgctgctgtgggtgactgcagctggtcaccgggcttctgccaagcacactctgtctgtc

SEQ ID NO: 732436 - DNA, 983 bp, Homo sapiens; identical to SEQ ID NO: 706180

SEQ ID NO: 732437 - DNA, 1606 bp, Homo sapiens
agaaactctctgtcctgagaggtgattaaagaaggcatccagcaagaactgcacaagaaacggagtcagccggagaacaaggagtggtcttccactgcctcacaggaggatggaggcccacaacgcgtctgccccattcaacttcaccctgccacccaactttggcaagcgccccacagacctggcactgagcgtcatcctggtgttcatgttgttcttcatcatgctctcgctgggctgcaccatggagttcagcaagatcaaggctcacttatggaagcctaaagggctggccatcgccctggtggcacagtatggcatcatgcccctcacggcctttgtgctgggcaaggtcttccggctgaagaacattgaggcactggccatcttggtctgtggctgctcacctggagggaacctgtccaatgtcttcagtctggccatgaagggggacatgaacctcagcattgtgatgaccacctgctccaccttctgtgcccttggcatgatgcctctcctcctgtacatctactccagggggatctatgatggggacctgaaggacaaggtgccctataaaggcatcgtgatatcactggtcctggttctcattccttgcaccatagggatcgtcctcaaatccaaacggccacaatacatgcgctatgtcatcaagggagggatgatcatcattctcttgtgcagtgtggccgtcacagttctctctgccatcaatgtggggaagagcatcatgtttgccatgacaccactcttgattgccacctcctccctgatgccttttattggctttctgctgggttatgttctctctgctctcttctgcctcaatggacggtgcagacgcactgtcagcatggagactggatgccaaaatgtccaactctgttccaccatcctcaatgtggcctttccacctgaagtcattggaccacttttcttctttcccctcctctacatgattttccagcttggagaagggcttctcctcattgccatattttggtgctatgagaaattcaagactcccaaggataaaacaaaaatgatctacacagctgccacaactgaagaaacaattccaggagctctgggaaatggcacctacaaaggggaggactgctccccttgcacagcctagcccttcccctggtggcctggattctggtcccaaagcaattctgaaagccagtgtggtaaactagagagagcagcaaaaacaccagtcttgcctgagtctttctccagcatttccagtacatctatcagaatcatcaagtcttggccgggaacacagacagggtgtctacccaagaagcctcacctatccccaacttagaatttgctacttattttaaagacttgttcagtgactgtaaactctatgaaaccagaaaccgaatctgcctcttgctgggatctctaaaagtgtctgataagcatcttaaagtcactcaattcctgaactaatcaatatatatgtttaacccattactcaaatacccaaatcccattccaagttttgtgacccaaaagagaaataaatgctcacaagtgctgtagaattaaacttcagaagttctaacct

SEQ ID NO: 732438 - DNA, 642 bp, Homo sapiens
ataaaacaaaaatgatctacacagctgccacaactgaagaaacaattccaggagctctgggaaatggcacctacaaaggggaggactgctccccttgcacagcctagcccttcccctggtggcctggattctggtcccaaagcaattctgaaagccagtgtggtaaactagagagagcagcaaaaacaccagtcttgcctgagtctttctccagcatttccagtacatctatcagaatcatcaagtcttggccgggaacacagacagggtgtctacccaagaagcctcacctatccccaacttagaatttgctacttattttaaagacttgttcagtgactgtaaactctatgaaaccagaaaccgaatctgcctcttgctgggatctctaaaagtgtctgataagcatcttaaagtcactcaattcctgaactaatcaatatatatgtttaacccattactcaaatacccaaatcccattccaagttttgtgacccaaaagagaaataaatgctcacaagtgctgtagaattaaacttcagaagttctaacctaaaaagttcagatcctattccttcccttttgacattattgggatgatgctcccgaaaagtcaaatttgacatcaagtatgcaaaagtg

SEQ ID NO: 732439 - DNA, 808 bp, Homo sapiens
aaaccataccatatcccaccagagagtgactcctgattgcctcctcaagtcgcagacactatgctgcctcccatggccctgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtagcagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttctgtttcttcctccccgctgtcatttcagtctcttcattttgtcatacggcctaaggctttaaagagcaataaaatttttagtctgca

SEQ ID NO: 732440 - DNA, 785 bp, Homo sapiens
aaaccataccatatcccaccagagagtcgcagacactatgctgcctcccatggccctgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtagcagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttctgtttcttcctccccgctgtcatttcagtctcttcattttgtcatacggcctaaggctttaaagagcaataaaatttttagtctgca

SEQ ID NO: 732441 - DNA, 908 bp, Homo sapiens
  misc_feature (1)..(1): n is a, c, g, or t
ntcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattccaa

SEQ ID NO: 732442 - DNA, 520 bp, Homo sapiens
  misc_feature (125)..(125): n is a, c, g, or t
ggcaggagttattgccacagccacacacgaggcccagtgggagagcgtcaagttgcctaattccttccggttggtgaaatcctttcccaaggagacaccttgtaacatcaccggtgggggcggtntttataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattccaa

SEQ ID NO: 732443 - DNA, 485 bp, Homo sapiens
  misc_feature (1)..(1): n is a, c, g, or t
ntcctatcatcgcaaaactcatgatgctccggctgctcagttccctcctccttgtggccgttgcctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattccaa

SEQ ID NO: 732444 - DNA, 487 bp, Homo sapiens
  misc_feature (2)..(2): n is a, c, g, or t
  misc_feature (10)..(10): n is a, c, g, or t
  misc_feature (12)..(12): n is a, c, g, or t
gngcaggggncnacgagcggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctaccatagcaagccactagaaccaaggcccagctggcagtgctgatcgatcccacatcctgaataaagaataaagatctctcagaaaattccaa

SEQ ID NO: 732445 - DNA, 896 bp, Homo sapiens; identical to SEQ ID NO: 262037
  misc_feature (2)..(2): n is a, c, g, or t
  misc_feature (10)..(10): n is a, c, g, or t
  misc_feature (12)..(12): n is a, c, g, or t

SEQ ID NO: 732446 - DNA, 1033 bp, Homo sapiens
  misc_feature (2)..(2): n is a, c, g, or t
  misc_feature (10)..(10): n is a, c, g, or t
  misc_feature (12)..(12): n is a, c, g, or t
gngcaggggncnacgagcggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaaactacagggcaacaaggcaccagagtcccggacttaggaccactgtgtgtgattcaccgtgaacactggcatattaaaggctctgagaagtcctgtaggaaaggacaatttgactttgtttgagctcatattttccaatcccatctgacctttagttcttcactgagtgcccactgggttatattctgggagccgaggccacagcagtgaacaaagcacacaaaaccc

SEQ ID NO: 732447 - DNA, 1045 bp, Homo sapiens
  misc_feature (1)..(1): n is a, c, g, or t
ntcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaaactacagggcaacaaggcaccagagtcccggacttaggaccactgtgtgtgattcaccgtgaacactggcatattaaaggctctgagaagtcctgtaggaaaggacaatttgactttgtttgagctcatattttccaatcccatctgacctttagttcttcactgagtgcccactgggttatattctgggagccgaggccacagcagtgaacaaagcacacaaaaccc

SEQ ID NO: 732448 - DNA, 1084 bp, Homo sapiens
tttttctagagatgaggtcttgctatgttgcccaggctggtctcaaactcccgggctcaagcgatcctcccgcctcggcctctcaaagcactaggattacagcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctacatcaccggctggggccgtctctataccaacgggccactcccagacaagctgcaggaggccctgctgcccgtggtggactatgaacactgctccaggtggaactggtggggttcctccgtgaagaagaccatggtgtgtgctggaggggacatccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaaactacagggcaacaaggcaccagagtcccggacttaggaccactgtgtgtgattcaccgtgaacactggcatattaaaggctctgagaagtcctgtaggaaaggacaatttgactttgtttgagctcatattttccaatcccatctgacctttagttcttcactgagtgcccactgggttatattctgggagccgaggccacagcagtgaacaaagcacacaaaaccc

SEQ ID NO: 732449 - DNA, 947 bp, Homo sapiens; identical to SEQ ID NO: 262036

SEQ ID NO: 732450 - DNA, 1643 bp, Homo sapiens; identical to SEQ ID NO: 73264

SEQ ID NO: 732451 - DNA, 3427 bp, Homo sapiens
ggccaggcaagcctgaatcctgtccctgccatctcgccactgcagctcgggtccagaaaggcaccattttgtcgcggctgcccgctctcccagggggaggagggatcttttttgcattttggagcggctgccaaggaggggaacctgttgggcatctccccagacccgcttgtgagcgcctccggggcgggcgggcgggaccagacccctcggggcacggcgtatcttggcacccggaggcagcggaggcaggcgcagcatcctcgctgggaactggagctggagtgagcgcaccgcgcgggaggagccgccgcagcctcgcagaacccgagtggaggaggtgacagctccattgccgggtttttattttttttctctccgcctccccgtctcctcctcaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttagacaaattcttcttgttttgtgaaaaaccagaactagtcagtatctcctgcccctccaccatttttttttccattttccattttcctttgaacaatttcatttaagccagagatttattgcatgaagctgagaagaggatgcagaatgacaaggaaagggcacatcaaccctgctatgctctttttttgtaagctccatagaaacagcctgagaatttggctagggaacttgaatgcttcaggggacagaaagagagcactttcgacacagtgcttcccagagtgagcttggcagggccaggcggggccaaattccatctgctgccttgttactcttgctttttgtgctcttaaatggctccatataatcttctacttacatgttccttggcttttttctcttcaaccttttccagcttatttattccattgacttctaaaggccgagtcctgggtgcttattatctggtgttctaaatgaagcagtaagttggaagcagtgccaccacccctgagtccctgagaaaggctggtctgttctttttgggtgtttctcctaagcagcaccctcccctcctcctggttttggtaaccaaaagtaacaatccatcaacctccattgtacctagaacaaaaatagccaataaaaacgctgagttgtgaagtccaatcaggcacttctaactcaccccaagctcgccatctggaaaaacagaccagaaggcttctcttctacagaaatgaactgtggggaaatcaagcagctgtgacatgaagtgaatgaagtccacttgaagctgtggaagatggttcatccttttccccagttgaggatccagatttataacttctagaaagccatttccagaaggttctatgtggcacacccctaggaaaggcactaaatgcatgcaaaggatttataaacttaggaaagtagatgggtggagtccagaaaactggttctgggttaatatctctacatctgtcttgatgactcatttctcctaactcccatttagtgcagggtaaatggtttgagatgagagtttttcaatgaaagggaaattttctttcagtttacagatgtattagaagtcctgactttcaagtgtaatttgctttggaggagg

SEQ ID NO: 732452 - DNA, 1978 bp, Homo sapiens
aatgcaccagccgcctccagcctcctgcagcagcagcagcagcagcagcagcagcagctgcgagtgcgcgcgtgtgggtgtgagggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 732453 - DNA, 2065 bp, Homo sapiens
tcagcaaatcctgttcagaggagcttcagccaatgaagaggctatatcccggcttgcttgggggcttctgagtttgagctgcatgcagaaatgtaaggcagtgcttcctggcgctgatggcaaaatgggacccatctccagttattcctcgggcaccccagctttgcaaatctgggaaagaacctacataaacatattggtgatgtagccagcttaaaaggccgagagaatccttatggattcaggagactgtttttttatttagatttttattttttatttggaagatgaaatgcttctctcgttacctgccttacatcttcagacctccgaacaccatcctttcttccagctgccacacagaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 732454 - DNA, 1982 bp, Homo sapiens
actgcaagtccttcgtaaccactccaggacgctgccagggcctgagaagggacaaactccaattgctccagttcaaactggtcctggcctggtcaaacggaggagacagagcagtgattcacagcaggacgtggaattgggacactcacccaggacacactatggtgcttcagccaagtgaaaggcactatcgagattggaaccacagaagatgtgccttgcttccccttcgccttctgccatgattgtaagtttcctgagacctccccagccatgcagaactctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 732455 - DNA, 2169 bp, Homo sapiens
actgcaagtccttcgtaaccactccaggacgctgccagggcctgagaagggacaaactccaattgctccagttcaaactggtcctggcctggtcaaacggaggagacagagcagtgattcacagcaggacgtggtacttgcagactgaccgtcctctcaggactcactagggtctcttctctgacgagatgatacctggaattgggacactcacccaggacacactatggtgcttcagccaagtgaaaggcactatcgagattggaaccacagaaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 732456 - DNA, 738 bp, Homo sapiens
ggccaggcaagcctgaatcctgtccctgccatctcgccactgcagctcgggtccagaaaggcaccattttgtcgcggctgcccgctctcccagggggaggagggatcttttttgcattttggagcggctgccaaggaggggaacctgttgggcatctccccagacccgcttgtgagcgcctccggggcgggcgggcgggaccagacccctcggggcacggcgtatttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 732457 - DNA, 2259 bp, Homo sapiens
tcagcaaatcctgttcagaggagcttcagccaatgaagaggctatatcccggcttgcttgggggcttctgagtttgagctgcatgcagaaatgtaaggcagtgcttcctggcgctgatggcaaaatgggacccatctccagttattcctcgggcaccccagctttgcaaatctgggaaagaacctacataaacatattggtgatgtagccagcttaaaaggccgagagaatccttatggattcaggagactgtttttttatttagatttttattttttatttggaagatgaaatgcttctctcgttacctgccttacatcttcagacctccgaacaccatcctttcttccagctgccacacagaaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 732458 - DNA, 1989 bp, Homo sapiens
actgcaagtccttcgtaaccactccaggacgctgccagggcctgagaagggacaaactccaattgctccagttcaaactggtcctggcctggtcaaacggaggagacagagcagtgattcacagcaggacgtggaattgggacactcacccaggacacactatggtgcttcagccaagtgaaaggcactatcgagattggaaccacagaaggagccaagggagaacccaagacagagaatagtggcccaataatgaagcatgaattatccagatgaaaacacctatggaactgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 732459 - DNA, 286 bp, Homo sapiens
tgtggagtctaggatgttgaagagagctgggaggagatgccaagaacactaggctgcttcctaccatctagcttacagtccaacatgtgagtaacaccaatacaaatgaaaagccatcaaatgtgtccaatagtgaatatcatcccggcagtctctgagctaggagggagagtcctggagaggtgtttattttctgatataaaaaaggagccaagggagaacccaagacagagaatagtggcccaataatgaagcatgaattatccagatgaaaacacctatggaa

SEQ ID NO: 732460 - DNA, 1707 bp, Homo sapiens
agaaggaggaaggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacgcaggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 732461 - DNA, 411 bp, Homo sapiens
  misc_feature (13)..(13): n is a, c, g, or t
  misc_feature (27)..(27): n is a, c, g, or t
tggccagggaaanccccccaaaccccnggacagtcaaagtcctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 732462 - DNA, 946 bp, Homo sapiens
cagcctacagccgtgctcaggaagtttctggatcctaggctcagctccacagaggagaacacgcaggcgcagagaccatggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctataccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccaggggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctgtgagtatcttttgttcctctgtgggccaggacaccagcttaaatctaaatgaccacaagccagtcctctcagtctttctccggtccaagtatagacacctttatttctggacatctgagctggccatgactccctgcccttggaaaacctaggtaggc

SEQ ID NO: 732463 - DNA, 1428 bp, Homo sapiens
agaaggaggaaggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacgcaggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctccatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 732464 - DNA, 2014 bp, Homo sapiens
  misc_feature (1788)..(1788): n is a, c, g, or t
  misc_feature (1790)..(1790): n is a, c, g, or t
  misc_feature (1800)..(1800): n is a, c, g, or t
agaaggaggaaggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacgcaggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaaaaaaaaaaaaaaaaaaaaaaaaaaaacaaaaaaaaaaaaaacaaaaaacaaaacaaaacaacaaacaaaacaaaacaaaananaaagagaaanagacaaagagagagacaaaaaagaaaaacaagaaagaaaaaaaaagagaacaaaaagacaccaagaacagcacacaacacagaaaggaggcgggcgggcgcgcgacggcgggaaagaaagacgaaaaaaagaccaagggggcgcgaggacagccgaccgcgagtgacacgagagcgacgagaaagagcggcgccccgaagacaggaggtcgagt

SEQ ID NO: 732465 - DNA, 1735 bp, Homo sapiens
  misc_feature (1509)..(1509): n is a, c, g, or t
  misc_feature (1511)..(1511): n is a, c, g, or t
  misc_feature (1521)..(1521): n is a, c, g, or t
agaaggaggaaggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacgcaggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctccatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaaaaaaaaaaaaaaaaaaaaaaaaaaaacaaaaaaaaaaaaaacaaaaaacaaaacaaaacaacaaacaaaacaaaacaaaananaaagagaaanagacaaagagagagacaaaaaagaaaaacaagaaagaaaaaaaaagagaacaaaaagacaccaagaacagcacacaacacagaaaggaggcgggcgggcgcgcgacggcgggaaagaaagacgaaaaaaagaccaagggggcgcgaggacagccgaccgcgagtgacacgagagcgacgagaaagagcggcgccccgaagacaggaggtcgagt

SEQ ID NO: 732466 - DNA, 696 bp, Homo sapiens
  misc_feature (19)..(19): n is a, c, g, or t
  misc_feature (470)..(470): n is a, c, g, or t
  misc_feature (472)..(472): n is a, c, g, or t
  misc_feature (482)..(482): n is a, c, g, or t
ctgtctagaggatcccagngtcatgtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaaaaaaaaaaaaaaaaaaaaaaaaaaaacaaaaaaaaaaaaaacaaaaaacaaaacaaaacaacaaacaaaacaaaacaaaananaaagagaaanagacaaagagagagacaaaaaagaaaaacaagaaagaaaaaaaaagagaacaaaaagacaccaagaacagcacacaacacagaaaggaggcgggcgggcgcgcgacggcgggaaagaaagacgaaaaaaagaccaagggggcgcgaggacagccgaccgcgagtgacacgagagcgacgagaaagagcggcgccccgaagacaggaggtcgagt

SEQ ID NO: 732467 - DNA, 389 bp, Homo sapiens
  misc_feature (19)..(19): n is a, c, g, or t
ctgtctagaggatcccagngtcatgtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 732468 - DNA, 1148 bp, Homo sapiens
agaaggaggaaggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacgcaggaaggatgcaggaacctacaccttacacatcataaagcgaggtgatgagactagagaagaaattcgacatttcaccttcaccttatactatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 732469 - DNA, 1455 bp, Homo sapiens
  misc_feature (1229)..(1229): n is a, c, g, or t
  misc_feature (1231)..(1231): n is a, c, g, or t
  misc_feature (1241)..(1241): n is a, c, g, or t
agaaggaggaaggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacgcaggaaggatgcaggaacctacaccttacacatcataaagcgaggtgatgagactagagaagaaattcgacatttcaccttcaccttatactatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaaaaaaaaaaaaaaaaaaaaaaaaaaaacaaaaaaaaaaaaaacaaaaaacaaaacaaaacaacaaacaaaacaaaacaaaananaaagagaaanagacaaagagagagacaaaaaagaaaaacaagaaagaaaaaaaaagagaacaaaaagacaccaagaacagcacacaacacagaaaggaggcgggcgggcgcgcgacggcgggaaagaaagacgaaaaaaagaccaagggggcgcgaggacagccgaccgcgagtgacacgagagcgacgagaaagagcggcgccccgaagacaggaggtcgagt

SEQ ID NO: 732470 - DNA, 1967 bp, Homo sapiens
agaaggaggaaggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacgcaggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctccatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtaagtggatcccagcatccttggcagtagggttttatgtggagtctatctggctttcagagaagagtcaggaaaacatttttattcccagcctgtgtcccatgggcacaagcaaatcccaaattctcctcctgaaccctcccaatttgtctctacagactctcttctccttgtttttctgttttcttatggctgaccttgtgtctggcctgaaaaaggtagggagggggctttatcagccctgagccctatgtggtagaagaggcttcagagagggacaagaagggaattccaaggcagcgtccgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctgggaccccatggccttcagccctggctgagcaactgggctgtagggcagggcacttctgaggtcaggtcttggtaggtgcctgcatctgtctgccttctggctgacaatcctggaaatctgttctccagaatcaggccaaaaagttcacagtcaaatggggaggggtattcttcatgcaggagacccctaggccctggaggctgcaacatacctcaatcctgtcccaggccggatcctcctgaagcccttttcgcagcactgctatcctccaaagccattgtaaatgtgtgtacagtgtgtataaaccttcttcttctttttttttttttaaactgaggattgtcattaaacacagttgttttct

SEQ ID NO: 732471 - DNA, 965 bp, Homo sapiens
agaaggaggaaggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacgcaggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcatgacccagtcaccctgaatgtcctctgtgagtatcttttgttcctctgtgggccaggacaccagcttaaatccaaaccaccagaggccaggtctctcagtctctctccagtccaagtatagacacctttacttctggacatccgaggtggccatgactccctgccctgggaaaacctaggtagg

SEQ ID NO: 732472 - DNA, 465 bp, Homo sapiens
aactctgattgaagtatgcctgtggaggaatcaaaggtgccacacaggacaatcttctctctgttatccacacagcaaagctgtccaagccctacatcacaatcaacaacttaaaccccagagagaataaggatgtcttaaccttcacctgtgaacctaagagtaagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctgtgagtatcttttgttcctctgtgggccaggacaccagcttaaatccaaaccaccagaggccaggtctctcagtctctctccagtccaagtatagacacctttacttctgg

SEQ ID NO: 732473 - DNA, 2049 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732474 - DNA, 643 bp, Homo sapiens; identical to SEQ ID NO: 362259

SEQ ID NO: 732475 - DNA, 389 bp, Homo sapiens
gctcggtacccctctatccttaatctggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagag

SEQ ID NO: 732476 - DNA, 878 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagag

SEQ ID NO: 732477 - DNA, 1866 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732478 - DNA, 695 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagag

SEQ ID NO: 732479 - DNA, 1893 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732480 - DNA, 2076 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732481 - DNA, 979 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcattacccttctgtcgtcttctcgagtcctctaatc

SEQ ID NO: 732482 - DNA, 1087 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaat

SEQ ID NO: 732483 - DNA, 1392 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732484 - DNA, 1846 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732485 - DNA, 1819 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732486 - DNA, 1162 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcattacccttctgtcgtcttctcgagtcctctaatc

SEQ ID NO: 732487 - DNA, 1270 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaat

SEQ ID NO: 732488 - DNA, 1575 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732489 - DNA, 2029 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732490 - DNA, 2002 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732491 - DNA, 1043 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccgtgagtatcctcggttcctctgtgagccaggctgccatcccaaatacacatggccagaggccaggcctctcagtccctctcaggtccaagtacagagacctttacccctggacatcaaagctggccatgactttctgccccaggcaaaacagagtaggcctaggcttgatccacaataggagaaaagaggctgctcctgtcatgggagactcaggttccacagcttgtgatgggagaaacaggtgaatgtctcaggctccagatcagtgaacacagcggggatttggctgggacttcagtgagtgccagccacagtgacccagtcaccctgaatctcctccgtgagtatcctctgttcctctgtgagccaggctgccatcccaaatacacatggccag

SEQ ID NO: 732492 - DNA, 1915 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732493 - DNA, 980 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctcccaagccctacatctccagcagcaacttaaaccccagggaggccatggaggctgtgatcttaacctgtgatcctgcggcttcagacacaagctacctgtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccacagtgacccagtcaccctgaatctcctccgtgagtatcctctgttcctctgtgagccaggctgccatcccaaatacacatggccag

SEQ ID NO: 732494 - DNA, 1021 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaat

SEQ ID NO: 732495 - DNA, 1827 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732496 - DNA, 1800 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732497 - DNA, 1849 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732498 - DNA, 1326 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732499 - DNA, 1780 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732500 - DNA, 1753 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732501 - DNA, 799 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacaccagtcagaacataacatgaggtctaaactcctgacaactttttatgggaaaattacagtattacgaattgagcatcggaaatccagaaatccacaatctgaaatgctccaaaactcaacccttctgaccactgatgtgatgttaaaaagaagtgctcactggcgcattgtggattttaaatttttcagatttgggatgctaaaccagtacatgtactgcaaatattccaaaattaaaaaaattagaaatcc

SEQ ID NO: 732502 - DNA, 1226 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccgtgagtatcctcggttcctctgtgagccaggctgccatcccaaatacacatggccagaggccaggcctctcagtccctctcaggtccaagtacagagacctttacccctggacatcaaagctggccatgactttctgccccaggcaaaacagagtaggcctaggcttgatccacaataggagaaaagaggctgctcctgtcatgggagactcaggttccacagcttgtgatgggagaaacaggtgaatgtctcaggctccagatcagtgaacacagcggggatttggctgggacttcagtgagtgccagccacagtgacccagtcaccctgaatctcctccgtgagtatcctctgttcctctgtgagccaggctgccatcccaaatacacatggccag

SEQ ID NO: 732503 - DNA, 2098 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732504 - DNA, 1163 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctcccaagccctacatctccagcagcaacttaaaccccagggaggccatggaggctgtgatcttaacctgtgatcctgcggcttcagacacaagctacctgtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccacagtgacccagtcaccctgaatctcctccgtgagtatcctctgttcctctgtgagccaggctgccatcccaaatacacatggccag

SEQ ID NO: 732505 - DNA, 1204 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaat

SEQ ID NO: 732506 - DNA, 2010 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732507 - DNA, 1983 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732508 - DNA, 2032 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732509 - DNA, 1509 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732510 - DNA, 1963 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732511 - DNA, 1936 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732512 - DNA, 812 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagag

SEQ ID NO: 732513 - DNA, 1797 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732514 - DNA, 1770 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732515 - DNA, 952 bp, Homo sapiens
tagaggatccctatcagagcatacccctactcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732516 - DNA, 925 bp, Homo sapiens; identical to SEQ ID NO: 362273

SEQ ID NO: 732517 - DNA, 451 bp, Homo sapiens
tagaggatccctatcagagcatacccctactcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732518 - DNA, 1366 bp, Homo sapiens
gtgagtatcttttgttcctctgtgggccaggacaccagcttaaatccaaaccaccagaggccaggtctctcagtctctctccagtccaagtatagacacctttacttctggacatccgaggtggccatgactccctgccctgggaaaacctaggtaggcacagccttaaccaagaatataaggggaggggacgctcttgtcatgggagacttggggcctaaaacttgtgatgggagaaacagtgaacatagagggagtttggctgggacttgaaggtgtgtcttggcttagagggtaactgtgtccctttaagagaccaggaacatccccttccctcggatgacatcacctatggctttattctctttgcgccagatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732519 - DNA, 1010 bp, Homo sapiens
  misc_feature (26)..(26): n is a, c, g, or t
tctagaggatcctgcgggagccttancctccgggagccttaatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732520 - DNA, 983 bp, Homo sapiens; identical to SEQ ID NO: 362298
  misc_feature (26)..(26): n is a, c, g, or t

SEQ ID NO: 732521 - DNA, 864 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcctacaaaggacaactgatggacctctaccattacattacatcatatgtagtagacggtcaaataattatatatgggcctgcatacagtggacgagaaacagtatattcccatgcatccctgctgatccagaatgtcacccgggaagacgcaggatcctacaccttacacatcataaagcgaggtgataggactagaggagtaactggatatttcaccttc

SEQ ID NO: 732522 - DNA, 1864 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732523 - DNA, 1837 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732524 - DNA, 1886 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732525 - DNA, 1363 bp, Homo sapiens
ctgctccgcccctctctgctgctccgcccctctctgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732526 - DNA, 1047 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcctacaaaggacaactgatggacctctaccattacattacatcatatgtagtagacggtcaaataattatatatgggcctgcatacagtggacgagaaacagtatattcccatgcatccctgctgatccagaatgtcacccgggaagacgcaggatcctacaccttacacatcataaagcgaggtgataggactagaggagtaactggatatttcaccttc

SEQ ID NO: 732527 - DNA, 2047 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732528 - DNA, 2020 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732529 - DNA, 2069 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732530 - DNA, 1546 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732531 - DNA, 1077 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcattacccttctgtcgtcttctcgagtcctctaatc

SEQ ID NO: 732532 - DNA, 793 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagag

SEQ ID NO: 732533 - DNA, 979 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctcccaagccctacatctccagcagcaacttaaaccccagggaggccatggaggctgtgatcttaacctgtgatcctgcggcttcagacacaagctacctgtggtggatgaatggtcagagcctccctatgactcacaggttgcagctgtccaaaaccaacaggaccctctttatatttggtgtcacaaagtatattgcaggaccctatgaatgtgaaatacggaacccag

SEQ ID NO: 732534 - DNA, 1185 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaat

SEQ ID NO: 732535 - DNA, 1991 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732536 - DNA, 1964 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732537 - DNA, 2013 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732538 - DNA, 1490 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732539 - DNA, 1944 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732540 - DNA, 1917 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732541 - DNA, 1962 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732542 - DNA, 1935 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732543 - DNA, 1984 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732544 - DNA, 1461 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732545 - DNA, 492 bp, Homo sapiens
acatggccagaggccaggcctctcagtccctctcaggtccaagtacagatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccgtgagtatcctcggttcctctgtgagccaggctgccatcccaaatacacatggccagaggccaggcctctcagtccctctcaggtccaagtacagagacctttacccctggacatcaaagctggccatgactttctgccccaggcaaaacagagtaggcctaggcttgatccacaataggagaaaagaggctgctcctgtcatgggagactcaggttccacagcttgtgatgggagaaacaggtgaatgtctcaggctccagatcagtgaacacagcggggatttggctgggacttcag

SEQ ID NO: 732546 - DNA, 1576 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732547 - DNA, 1549 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732548 - DNA, 1598 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732549 - DNA, 1075 bp, Homo sapiens
ctgccccgggaggaggctcgacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732550 - DNA, 1183 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcctacaaaggacaactgatggacctctaccattacattacatcatatgtagtagacggtcaaataattatatatgggcctgcatacagtggacgagaaacagtatattcccatgcatccctgctgatccagaatgtcacccgggaagacgcaggatcctacaccttacacatcataaagcgaggtgataggactagaggagtaactggatatttcaccttc

SEQ ID NO: 732551 - DNA, 1362 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccgtgagtatcctcggttcctctgtgagccaggctgccatcccaaatacacatggccagaggccaggcctctcagtccctctcaggtccaagtacagagacctttacccctggacatcaaagctggccatgactttctgccccaggcaaaacagagtaggcctaggcttgatccacaataggagaaaagaggctgctcctgtcatgggagactcaggttccacagcttgtgatgggagaaacaggtgaatgtctcaggctccagatcagtgaacacagcggggatttggctgggacttcagtgagtgccagccacagtgacccagtcaccctgaatctcctccgtgagtatcctctgttcctctgtgagccaggctgccatcccaaatacacatggccag

SEQ ID NO: 732552 - DNA, 1298 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcattacccttctgtcgtcttctcgagtcctctaatc

SEQ ID NO: 732553 - DNA, 1406 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaat

SEQ ID NO: 732554 - DNA, 2212 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732555 - DNA, 2185 bp, Homo sapiens; identical to SEQ ID NO: 362287

SEQ ID NO: 732556 - DNA, 2234 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732557 - DNA, 1711 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732558 - DNA, 2165 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732559 - DNA, 2138 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732560 - DNA, 1014 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagag

SEQ ID NO: 732561 - DNA, 1299 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctcccaagccctacatctccagcagcaacttaaaccccagggaggccatggaggctgtgatcttaacctgtgatcctgcggcttcagacacaagctacctgtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccacagtgacccagtcaccctgaatctcctccgtgagtatcctctgttcctctgtgagccaggctgccatcccaaatacacatggccag

SEQ ID NO: 732562 - DNA, 2183 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732563 - DNA, 2156 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732564 - DNA, 2205 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732565 - DNA, 1682 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732566 - DNA, 1340 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaat

SEQ ID NO: 732567 - DNA, 2146 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732568 - DNA, 2119 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732569 - DNA, 2168 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732570 - DNA, 1645 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctaaaaggtc

SEQ ID NO: 732571 - DNA, 2099 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaaaacaacaaaaaaaaacc

SEQ ID NO: 732572 - DNA, 2072 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 732573 - DNA, 1447 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccat

SEQ ID NO: 732574 - DNA, 1168 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccat

SEQ ID NO: 732575 - DNA, 805 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccat

SEQ ID NO: 732576 - DNA, 1847 bp, Homo sapiens
  misc_feature (1689)..(1689): n is a, c, g, or t
  misc_feature (1691)..(1691): n is a, c, g, or t
  misc_feature (1697)..(1699): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732577 - DNA, 3122 bp, Homo sapiens
  misc_feature (2964)..(2964): n is a, c, g, or t
  misc_feature (2966)..(2966): n is a, c, g, or t
  misc_feature (2972)..(2974): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732578 - DNA, 1568 bp, Homo sapiens
  misc_feature (1410)..(1410): n is a, c, g, or t
  misc_feature (1412)..(1412): n is a, c, g, or t
  misc_feature (1418)..(1420): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732579 - DNA, 2843 bp, Homo sapiens
  misc_feature (2685)..(2685): n is a, c, g, or t
  misc_feature (2687)..(2687): n is a, c, g, or t
  misc_feature (2693)..(2695): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732580 - DNA, 1107 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccat

SEQ ID NO: 732581 - DNA, 1769 bp, Homo sapiens
  misc_feature (1611)..(1611): n is a, c, g, or t
  misc_feature (1613)..(1613): n is a, c, g, or t
  misc_feature (1619)..(1621): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732582 - DNA, 3044 bp, Homo sapiens
  misc_feature (2886)..(2886): n is a, c, g, or t
  misc_feature (2888)..(2888): n is a, c, g, or t
  misc_feature (2894)..(2896): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732583 - DNA, 1490 bp, Homo sapiens
  misc_feature (1332)..(1332): n is a, c, g, or t
  misc_feature (1334)..(1334): n is a, c, g, or t
  misc_feature (1340)..(1342): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732584 - DNA, 2765 bp, Homo sapiens
  misc_feature (2607)..(2607): n is a, c, g, or t
  misc_feature (2609)..(2609): n is a, c, g, or t
  misc_feature (2615)..(2617): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732585 - DNA, 1029 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccat

SEQ ID NO: 732586 - DNA, 1908 bp, Homo sapiens
  misc_feature (1750)..(1750): n is a, c, g, or t
  misc_feature (1752)..(1752): n is a, c, g, or t
  misc_feature (1758)..(1760): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732587 - DNA, 3183 bp, Homo sapiens
  misc_feature (3025)..(3025): n is a, c, g, or t
  misc_feature (3027)..(3027): n is a, c, g, or t
  misc_feature (3033)..(3035): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732588 - DNA, 1986 bp, Homo sapiens
  misc_feature (1828)..(1828): n is a, c, g, or t
  misc_feature (1830)..(1830): n is a, c, g, or t
  misc_feature (1836)..(1838): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732589 - DNA, 3261 bp, Homo sapiens
  misc_feature (3103)..(3103): n is a, c, g, or t
  misc_feature (3105)..(3105): n is a, c, g, or t
  misc_feature (3111)..(3113): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732590 - DNA, 1707 bp, Homo sapiens
  misc_feature (1549)..(1549): n is a, c, g, or t
  misc_feature (1551)..(1551): n is a, c, g, or t
  misc_feature (1557)..(1559): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732591 - DNA, 2982 bp, Homo sapiens
  misc_feature (2824)..(2824): n is a, c, g, or t
  misc_feature (2826)..(2826): n is a, c, g, or t
  misc_feature (2832)..(2834): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732592 - DNA, 1246 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccat

SEQ ID NO: 732593 - DNA, 1629 bp, Homo sapiens
  misc_feature (1471)..(1471): n is a, c, g, or t
  misc_feature (1473)..(1473): n is a, c, g, or t
  misc_feature (1479)..(1481): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732594 - DNA, 2904 bp, Homo sapiens
  misc_feature (2746)..(2746): n is a, c, g, or t
  misc_feature (2748)..(2748): n is a, c, g, or t
  misc_feature (2754)..(2756): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732595 - DNA, 1545 bp, Homo sapiens
  misc_feature (1387)..(1387): n is a, c, g, or t
  misc_feature (1389)..(1389): n is a, c, g, or t
  misc_feature (1395)..(1397): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732596 - DNA, 2820 bp, Homo sapiens
  misc_feature (2662)..(2662): n is a, c, g, or t
  misc_feature (2664)..(2664): n is a, c, g, or t
  misc_feature (2670)..(2672): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732597 - DNA, 1266 bp, Homo sapiens
  misc_feature (1108)..(1108): n is a, c, g, or t
  misc_feature (1110)..(1110): n is a, c, g, or t
  misc_feature (1116)..(1118): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732598 - DNA, 2541 bp, Homo sapiens
  misc_feature (2383)..(2383): n is a, c, g, or t
  misc_feature (2385)..(2385): n is a, c, g, or t
  misc_feature (2391)..(2393): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732599 - DNA, 1930 bp, Homo sapiens
  misc_feature (1772)..(1772): n is a, c, g, or t
  misc_feature (1774)..(1774): n is a, c, g, or t
  misc_feature (1780)..(1782): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732600 - DNA, 4586 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732601 - DNA, 3205 bp, Homo sapiens
  misc_feature (3047)..(3047): n is a, c, g, or t
  misc_feature (3049)..(3049): n is a, c, g, or t
  misc_feature (3055)..(3057): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732602 - DNA, 4307 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732603 - DNA, 1852 bp, Homo sapiens
  misc_feature (1694)..(1694): n is a, c, g, or t
  misc_feature (1696)..(1696): n is a, c, g, or t
  misc_feature (1702)..(1704): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732604 - DNA, 4508 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732605 - DNA, 3127 bp, Homo sapiens
  misc_feature (2969)..(2969): n is a, c, g, or t
  misc_feature (2971)..(2971): n is a, c, g, or t
  misc_feature (2977)..(2979): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732606 - DNA, 4229 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732607 - DNA, 4647 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732608 - DNA, 2069 bp, Homo sapiens
  misc_feature (1911)..(1911): n is a, c, g, or t
  misc_feature (1913)..(1913): n is a, c, g, or t
  misc_feature (1919)..(1921): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732609 - DNA, 4725 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732610 - DNA, 3344 bp, Homo sapiens
  misc_feature (3186)..(3186): n is a, c, g, or t
  misc_feature (3188)..(3188): n is a, c, g, or t
  misc_feature (3194)..(3196): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732611 - DNA, 4446 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732612 - DNA, 1991 bp, Homo sapiens
  misc_feature (1833)..(1833): n is a, c, g, or t
  misc_feature (1835)..(1835): n is a, c, g, or t
  misc_feature (1841)..(1843): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732613 - DNA, 3266 bp, Homo sapiens
  misc_feature (3108)..(3108): n is a, c, g, or t
  misc_feature (3110)..(3110): n is a, c, g, or t
  misc_feature (3116)..(3118): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732614 - DNA, 4368 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732615 - DNA, 1628 bp, Homo sapiens
  misc_feature (1470)..(1470): n is a, c, g, or t
  misc_feature (1472)..(1472): n is a, c, g, or t
  misc_feature (1478)..(1480): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732616 - DNA, 4284 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732617 - DNA, 2903 bp, Homo sapiens
  misc_feature (2745)..(2745): n is a, c, g, or t
  misc_feature (2747)..(2747): n is a, c, g, or t
  misc_feature (2753)..(2755): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732618 - DNA, 4005 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732619 - DNA, 1762 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctggtaagtggatccctggagcattggcaccatgttttccagtaaagtctatctagctgtcagggaagagccacctgctctctgcaaagggagagggaaaatcaaaacccaggaaagggaatatgtttctgctccaaaaccaccagcttctgcctgtccccttcactctttctagatcattctttagacaatacactaacaatgaacaatctgaaaggaagttaaggaaagaatttcaattcacattaacatcaaaaggaataaaatattttggaataagtttaaccaaaaaggtcaaatgattataccctgaaaactacaaaacattgctgaaagaaattaaagacgatatcaata

SEQ ID NO: 732620 - DNA, 4669 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732621 - DNA, 1684 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctggtaagtggatccctggagcattggcaccatgttttccagtaaagtctatctagctgtcagggaagagccacctgctctctgcaaagggagagggaaaatcaaaacccaggaaagggaatatgtttctgctccaaaaccaccagcttctgcctgtccccttcactctttctagatcattctttagacaatacactaacaatgaacaatctgaaaggaagttaaggaaagaatttcaattcacattaacatcaaaaggaataaaatattttggaataagtttaaccaaaaaggtcaaatgattataccctgaaaactacaaaacattgctgaaagaaattaaagacgatatcaata

SEQ ID NO: 732622 - DNA, 4591 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732623 - DNA, 1823 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctggtaagtggatccctggagcattggcaccatgttttccagtaaagtctatctagctgtcagggaagagccacctgctctctgcaaagggagagggaaaatcaaaacccaggaaagggaatatgtttctgctccaaaaccaccagcttctgcctgtccccttcactctttctagatcattctttagacaatacactaacaatgaacaatctgaaaggaagttaaggaaagaatttcaattcacattaacatcaaaaggaataaaatattttggaataagtttaaccaaaaaggtcaaatgattataccctgaaaactacaaaacattgctgaaagaaattaaagacgatatcaata

SEQ ID NO: 732624 - DNA, 1901 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctggtaagtggatccctggagcattggcaccatgttttccagtaaagtctatctagctgtcagggaagagccacctgctctctgcaaagggagagggaaaatcaaaacccaggaaagggaatatgtttctgctccaaaaccaccagcttctgcctgtccccttcactctttctagatcattctttagacaatacactaacaatgaacaatctgaaaggaagttaaggaaagaatttcaattcacattaacatcaaaaggaataaaatattttggaataagtttaaccaaaaaggtcaaatgattataccctgaaaactacaaaacattgctgaaagaaattaaagacgatatcaata

SEQ ID NO: 732625 - DNA, 4808 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732626 - DNA, 4730 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732627 - DNA, 1460 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctggtaagtggatccctggagcattggcaccatgttttccagtaaagtctatctagctgtcagggaagagccacctgctctctgcaaagggagagggaaaatcaaaacccaggaaagggaatatgtttctgctccaaaaccaccagcttctgcctgtccccttcactctttctagatcattctttagacaatacactaacaatgaacaatctgaaaggaagttaaggaaagaatttcaattcacattaacatcaaaaggaataaaatattttggaataagtttaaccaaaaaggtcaaatgattataccctgaaaactacaaaacattgctgaaagaaattaaagacgatatcaata

SEQ ID NO: 732628 - DNA, 4367 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732629 - DNA, 3783 bp, Homo sapiens
  misc_feature (3625)..(3625): n is a, c, g, or t
  misc_feature (3627)..(3627): n is a, c, g, or t
  misc_feature (3633)..(3635): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732630 - DNA, 2508 bp, Homo sapiens
  misc_feature (2350)..(2350): n is a, c, g, or t
  misc_feature (2352)..(2352): n is a, c, g, or t
  misc_feature (2358)..(2360): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732631 - DNA, 5247 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732632 - DNA, 3705 bp, Homo sapiens
  misc_feature (3547)..(3547): n is a, c, g, or t
  misc_feature (3549)..(3549): n is a, c, g, or t
  misc_feature (3555)..(3557): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732633 - DNA, 2430 bp, Homo sapiens
  misc_feature (2272)..(2272): n is a, c, g, or t
  misc_feature (2274)..(2274): n is a, c, g, or t
  misc_feature (2280)..(2282): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732634 - DNA, 5169 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732635 - DNA, 2486 bp, Homo sapiens
  misc_feature (2328)..(2328): n is a, c, g, or t
  misc_feature (2330)..(2330): n is a, c, g, or t
  misc_feature (2336)..(2338): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732636 - DNA, 1211 bp, Homo sapiens
  misc_feature (1053)..(1053): n is a, c, g, or t
  misc_feature (1055)..(1055): n is a, c, g, or t
  misc_feature (1061)..(1063): n is a, c, g, or t
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732637 - DNA, 3950 bp, Homo sapiens
atattaactgatgctgtctctaccacacatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732638 - DNA, 3844 bp, Homo sapiens
  misc_feature (3686)..(3686): n is a, c, g, or t
  misc_feature (3688)..(3688): n is a, c, g, or t
  misc_feature (3694)..(3696): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732639 - DNA, 2569 bp, Homo sapiens
  misc_feature (2411)..(2411): n is a, c, g, or t
  misc_feature (2413)..(2413): n is a, c, g, or t
  misc_feature (2419)..(2421): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732640 - DNA, 5308 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732641 - DNA, 3922 bp, Homo sapiens
  misc_feature (3764)..(3764): n is a, c, g, or t
  misc_feature (3766)..(3766): n is a, c, g, or t
  misc_feature (3772)..(3774): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732642 - DNA, 2647 bp, Homo sapiens
  misc_feature (2489)..(2489): n is a, c, g, or t
  misc_feature (2491)..(2491): n is a, c, g, or t
  misc_feature (2497)..(2499): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732643 - DNA, 5386 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732644 - DNA, 2625 bp, Homo sapiens
  misc_feature (2467)..(2467): n is a, c, g, or t
  misc_feature (2469)..(2469): n is a, c, g, or t
  misc_feature (2475)..(2477): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732645 - DNA, 1350 bp, Homo sapiens
  misc_feature (1192)..(1192): n is a, c, g, or t
  misc_feature (1194)..(1194): n is a, c, g, or t
  misc_feature (1200)..(1202): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732646 - DNA, 4089 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732647 - DNA, 3362 bp, Homo sapiens
  misc_feature (3204)..(3204): n is a, c, g, or t
  misc_feature (3206)..(3206): n is a, c, g, or t
  misc_feature (3212)..(3214): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732648 - DNA, 2087 bp, Homo sapiens
  misc_feature (1929)..(1929): n is a, c, g, or t
  misc_feature (1931)..(1931): n is a, c, g, or t
  misc_feature (1937)..(1939): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732649 - DNA, 4826 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732650 - DNA, 1341 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctggtaagtggatccctggagcattggcaccatgttttccagtaaagtctatctagctgtcagggaagagccacctgctctctgcaaagggagagggaaaatcaaaacccaggaaagggaatatgtttctgctccaaaaccaccagcttctgcctgtccccttcactctttctagatcattctttagacaatacactaacaatgaacaatctgaaaggaagttaaggaaagaatttcaattcacattaacatcaaaaggaataaaatattttggaataagtttaaccaaaaaggtcaaatgattataccctgaaaactacaaaacattgctgaaagaaattaaagacgatatcaata

SEQ ID NO: 732651 - DNA, 3481 bp, Homo sapiens
  misc_feature (3323)..(3323): n is a, c, g, or t
  misc_feature (3325)..(3325): n is a, c, g, or t
  misc_feature (3331)..(3333): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732652 - DNA, 2206 bp, Homo sapiens
  misc_feature (2048)..(2048): n is a, c, g, or t
  misc_feature (2050)..(2050): n is a, c, g, or t
  misc_feature (2056)..(2058): n is a, c, g, or t
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaaacaaaaaaaaacagttgttggggcggcctngnggcccnnngaaaaagcttttctgagaacacattgctttgggacgccgcggggccccagtagggtcacggcggaacagtgggcgccacaacggtgtgttcctcagaggagaatcggggccaagagacataagggccgggggtttctcccataagaaa

SEQ ID NO: 732653 - DNA, 4945 bp, Homo sapiens
agcacagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaataagagagaagaggcttctcctgtcatgggagactcaggttccacagcttgtgatggaagaaacaggtgaatgtctcaggctccagatcagtgaacacagcggggatttggctgggacttcagtgttgcaacttggctcacagggtcactgtgactgtgtcccttccacagaccaggattttcccttccctctgacaatatcgcctgtgacattattctctttgctccgcatggcctggatgctcccaccgtttcttcctcatacacctattaccatacaggggaagtccccaagctctcctgcctcacagactctcacccactggcagagcattcttggctgattgatgggaagttccagcaatcagcacaagtgttctttataccccaaatcactaaaacatatagaggggtctatgtctgtttcatccataactcagccactggtggaacaaatctcataatcaagaggatcatagtccctgcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccat

SEQ ID NO: 732654 - DNA, 237 bp, Homo sapiens
cggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctgtgagtatcctttgttcctctgtgggccaggacaccagcttaactccaaacgaccagaggccaggcctctcagtctctctccggtccaag

SEQ ID NO: 732655 - DNA, 380 bp, Homo sapiens
aaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaagttaatgcacaggctgataccatccttggttctcttagtacggtcgcaggta

SEQ ID NO: 732656 - DNA, 716 bp, Homo sapiens
agaaggaggaaggacagcacagcctacagccgtgctcaggaagtttctggatcctaggctcagctccacagaggagaacacgcaggcgcagagaccatggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttataccaccctgctccagcacaggcccagcgagagacacacactcaggagctctcacataacaaatgaaggaatggaatgaagaaatgaatgatccaaaacctctttagagactggatgttggatgcagaatcctaggaggttctagccacacctgtcccttgtccttcagaggctgacatccatgtttcatcccc

SEQ ID NO: 732657 - DNA, 1591 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaaaaaagaaaaaaaaaaaaaaaaaaaaaaaaaaaaaaa

SEQ ID NO: 732658 - DNA, 1659 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaaaaaagaaaaaaaaaaaaaaaaaaaaaaaaaaaaaaa

SEQ ID NO: 732659 - DNA, 1605 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctggacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaataaacaaaaaaaaaaaaaaaaaaaaaaaaaaaaagaaaaaaaaaaaaaaaaaaaaaaaaaaaaaaa

SEQ ID NO: 732660 - DNA, 1576 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctggacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaaaaaagaaaaaaaaaaaaaaaaaaaaaaaaaaaaaaa

SEQ ID NO: 732661 - DNA, 1751 bp, Homo sapiens
  misc_feature (6)..(6): n is a, c, g, or t
  misc_feature (1662)..(1663): n is a, c, g, or t
  misc_feature (1669)..(1669): n is a, c, g, or t
  misc_feature (1673)..(1673): n is a, c, g, or t
  misc_feature (1678)..(1678): n is a, c, g, or t
  misc_feature (1681)..(1681): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaataaacaaaaaaaaaaaaaatttttgggcggcttgggcctnngaaagntttnttaanccntttgtttgggggccggggggctcattggtgttactctcacacagggccacaggggtcccagagaaaacct

SEQ ID NO: 732662 - DNA, 1688 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaataaacaaaaaaaaaaaaaaaaaaaaaaaaaaaaagaaaaaaaaaaaaaaaaaaaaaaaaaaaaaaa

SEQ ID NO: 732663 - DNA, 1620 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaataaacaaaaaaaaaaaaaaaaaaaaaaaaaaaaagaaaaaaaaaaaaaaaaaaaaaaaaaaaaaaa

SEQ ID NO: 732664 - DNA, 1073 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcgaggctaggacactggcgaggctagacactggcgaggctagga

SEQ ID NO: 732665 - DNA, 1366 bp, Homo sapiens
actgactacttgtgggagagaaggaaaaaaagctaagtgcaaagaatcaagcctgatatgttagtttttaccaactgagatgcacccaagatgggattagacatacaagataatttatcagggaggacacctgtgagggaatgtggggcagacatgaaggcagtatgggagaacccacagaccactatgcagagctgattcctgtgaaaaagaaagagaaagaagttttaggtaccaatgcagttctaagagtttttgcaaggctgagggggagtcctccaaccagtcaccctttagagttaaagagagcctcagagaactaggcttgctttcacgcccttcctgggagcctgtgggaaagaagctttctgtgcaaaggaggtgatgaatgtgaaatgcacggacgtgggccttctgtcaatcagctccctgccatggagacctgacagagtctcattcatggctgccacaacagagagactgagaaaaagatgcaaccatgaaaaggtgaaaaggtggtaagttctaatgacatagaaaatagcaatcagcctttcttatgtctgaaagccttccaaaatatctgagtgcagtagagatttgacagaggactgatcaccatcctagaaacatggtgagagggaaaaaaaaaactgcaagaatataatcatctcccatcaatttcccaagaggaataatgtagtacttgaagaaacaattatagagtacctcatgctacatgcctcttcctgaggctcccccatgtaaaataacatcaccttcattccttctttacttttctttccatgacagctccttcaggaataggacgtcttcctctccttaatccaatatagcagccgtgaagtcatttctgtatttcaggaagactggcaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaataaacaaaaaaaaaaaaaaaaaaaaaaaaaaaaagaaaaaaaaaaaaaaaaaaaaaaaaaaaaaaa

SEQ ID NO: 732666 - DNA, 1497 bp, Homo sapiens
  misc_feature (1408)..(1409): n is a, c, g, or t
  misc_feature (1415)..(1415): n is a, c, g, or t
  misc_feature (1419)..(1419): n is a, c, g, or t
  misc_feature (1424)..(1424): n is a, c, g, or t
  misc_feature (1427)..(1427): n is a, c, g, or t
actgactacttgtgggagagaaggaaaaaaagctaagtgcaaagaatcaagcctgatatgttagtttttaccaactgagatgcacccaagatgggattagacatacaagataatttatcagggaggacacctgtgagggaatgtggggcagacatgaaggcagtatgggagaacccacagaccactatgcagagctgattcctgtgaaaaagaaagagaaagaagttttaggtaccaatgcagttctaagagtttttgcaaggctgagggggagtcctccaaccagtcaccctttagagttaaagagagcctcagagaactaggcttgctttcacgcccttcctgggagcctgtgggaaagaagctttctgtgcaaaggaggtgatgaatgtgaaatgcacggacgtgggccttctgtcaatcagctccctgccatggagacctgacagagtctcattcatggctgccacaacagagagactgagaaaaagatgcaaccatgaaaaggtgaaaaggtggtaagttctaatgacatagaaaatagcaatcagcctttcttatgtctgaaagccttccaaaatatctgagtgcagtagagatttgacagaggactgatcaccatcctagaaacatggtgagagggaaaaaaaaaactgcaagaatataatcatctcccatcaatttcccaagaggaataatgtagtacttgaagaaacaattatagagtacctcatgctacatgcctcttcctgaggctcccccatgtaaaataacatcaccttcattccttctttacttttctttccatgacagctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaataaacaaaaaaaaaaaaaatttttgggcggcttgggcctnngaaagntttnttaanccntttgtttgggggccggggggctcattggtgttactctcacacagggccacaggggtcccagagaaaacct

SEQ ID NO: 732667 - DNA, 1337 bp, Homo sapiens
actgactacttgtgggagagaaggaaaaaaagctaagtgcaaagaatcaagcctgatatgttagtttttaccaactgagatgcacccaagatgggattagacatacaagataatttatcagggaggacacctgtgagggaatgtggggcagacatgaaggcagtatgggagaacccacagaccactatgcagagctgattcctgtgaaaaagaaagagaaagaagttttaggtaccaatgcagttctaagagtttttgcaaggctgagggggagtcctccaaccagtcaccctttagagttaaagagagcctcagagaactaggcttgctttcacgcccttcctgggagcctgtgggaaagaagctttctgtgcaaaggaggtgatgaatgtgaaatgcacggacgtgggccttctgtcaatcagctccctgccatggagacctgacagagtctcattcatggctgccacaacagagagactgagaaaaagatgcaaccatgaaaaggtgaaaaggtggtaagttctaatgacatagaaaatagcaatcagcctttcttatgtctgaaagccttccaaaatatctgagtgcagtagagatttgacagaggactgatcaccatcctagaaacatggtgagagggaaaaaaaaaactgcaagaatataatcatctcccatcaatttcccaagaggaataatgtagtacttgaagaaacaattatagagtacctcatgctacatgcctcttcctgaggctcccccatgtaaaataacatcaccttcattccttctttacttttctttccatgacagctccttcaggaataggacgtcttcctctccttaatccaatatagcagccgtgaagtcatttctgtatttcaggaagactggcaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaaaaaagaaaaaaaaaaaaaaaaaaaaaaaaaaaaaaa

SEQ ID NO: 732668 - DNA, 1434 bp, Homo sapiens
actgactacttgtgggagagaaggaaaaaaagctaagtgcaaagaatcaagcctgatatgttagtttttaccaactgagatgcacccaagatgggattagacatacaagataatttatcagggaggacacctgtgagggaatgtggggcagacatgaaggcagtatgggagaacccacagaccactatgcagagctgattcctgtgaaaaagaaagagaaagaagttttaggtaccaatgcagttctaagagtttttgcaaggctgagggggagtcctccaaccagtcaccctttagagttaaagagagcctcagagaactaggcttgctttcacgcccttcctgggagcctgtgggaaagaagctttctgtgcaaaggaggtgatgaatgtgaaatgcacggacgtgggccttctgtcaatcagctccctgccatggagacctgacagagtctcattcatggctgccacaacagagagactgagaaaaagatgcaaccatgaaaaggtgaaaaggtggtaagttctaatgacatagaaaatagcaatcagcctttcttatgtctgaaagccttccaaaatatctgagtgcagtagagatttgacagaggactgatcaccatcctagaaacatggtgagagggaaaaaaaaaactgcaagaatataatcatctcccatcaatttcccaagaggaataatgtagtacttgaagaaacaattatagagtacctcatgctacatgcctcttcctgaggctcccccatgtaaaataacatcaccttcattccttctttacttttctttccatgacagctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaataaacaaaaaaaaaaaaaaaaaaaaaaaaaaaaagaaaaaaaaaaaaaaaaaaaaaaaaaaaaaaa

SEQ ID NO: 732669 - DNA, 1405 bp, Homo sapiens
actgactacttgtgggagagaaggaaaaaaagctaagtgcaaagaatcaagcctgatatgttagtttttaccaactgagatgcacccaagatgggattagacatacaagataatttatcagggaggacacctgtgagggaatgtggggcagacatgaaggcagtatgggagaacccacagaccactatgcagagctgattcctgtgaaaaagaaagagaaagaagttttaggtaccaatgcagttctaagagtttttgcaaggctgagggggagtcctccaaccagtcaccctttagagttaaagagagcctcagagaactaggcttgctttcacgcccttcctgggagcctgtgggaaagaagctttctgtgcaaaggaggtgatgaatgtgaaatgcacggacgtgggccttctgtcaatcagctccctgccatggagacctgacagagtctcattcatggctgccacaacagagagactgagaaaaagatgcaaccatgaaaaggtgaaaaggtggtaagttctaatgacatagaaaatagcaatcagcctttcttatgtctgaaagccttccaaaatatctgagtgcagtagagatttgacagaggactgatcaccatcctagaaacatggtgagagggaaaaaaaaaactgcaagaatataatcatctcccatcaatttcccaagaggaataatgtagtacttgaagaaacaattatagagtacctcatgctacatgcctcttcctgaggctcccccatgtaaaataacatcaccttcattccttctttacttttctttccatgacagctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaaaaaagaaaaaaaaaaaaaaaaaaaaaaaaaaaaaaa

SEQ ID NO: 732670 - DNA, 2694 bp, Homo sapiens
  misc_feature (1359)..(1360): n is a, c, g, or t
  misc_feature (1364)..(1364): n is a, c, g, or t
  misc_feature (1366)..(1366): n is a, c, g, or t
  misc_feature (1371)..(1371): n is a, c, g, or t
  misc_feature (1378)..(1378): n is a, c, g, or t
  misc_feature (1389)..(1389): n is a, c, g, or t
  misc_feature (1391)..(1391): n is a, c, g, or t
  misc_feature (1407)..(1409): n is a, c, g, or t
  misc_feature (1413)..(1413): n is a, c, g, or t
  misc_feature (1418)..(1418): n is a, c, g, or t
  misc_feature (1423)..(1423): n is a, c, g, or t
  misc_feature (1427)..(1428): n is a, c, g, or t
  misc_feature (1432)..(1435): n is a, c, g, or t
  misc_feature (1438)..(1439): n is a, c, g, or t
  misc_feature (1443)..(1443): n is a, c, g, or t
  misc_feature (1448)..(1448): n is a, c, g, or t
  misc_feature (1450)..(1450): n is a, c, g, or t
  misc_feature (1454)..(1454): n is a, c, g, or t
  misc_feature (1456)..(1456): n is a, c, g, or t
  misc_feature (1466)..(1466): n is a, c, g, or t
  misc_feature (1470)..(1471): n is a, c, g, or t
  misc_feature (1487)..(1488): n is a, c, g, or t
agcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctggtaagtggatcccagcatccttggcaatagggttttaggtggagtctacctggctttcagagaagagttaggaaaacatttttattcccagcctgtgtcccatgggcacaagcaaatcccaaattctcctcctgaacccttccaatttgtctctacagactctcttctccttgtttttctgttttctcatggctgaccttgtgtctggcctaagaaagttagggagggggctttatcagccctgagccctatgtggtagaggaggcttcacagagggatgagaaggagagtcctcaagatcaagttgcttctcgatgtcaccaacacatccccttctgccatgtctttgtttccttgtacctattccatgagctacaaggaacatctgaggctctgaaacaagctcacacttttcccccaaatgagacgaggaagccccttgggtgagggaggaccnncccncnccccnccccccnccctcgccccncncccccccgcgcgaccnnncccnccccncccancccnncccnnnnccnncacnccccnanaaananccctcgcgcncccnnccccgaattccgcccnnatcgagctgccagttgaagccaagcctcccccgggccaggctgcagggaaataagaagagagggagcctcagggaagactcctgcgttgcgtcctggctctgaagtcaccggttgtatgaggttgtgggcacagcatgtgggacacagcacggaggatagtgactgatgcagagctggagaaatagagagattcacccctggggctctgcatggcaggaaaggggcagtgccaaaaagtgtgtaattatagagagggtaagactaccagacactttatatatatctaatataagacttaccattaactatttctatgtgtgcaatttagtgttgtgtaaccatcacactatccatttccagaactttttcctcttaccatattaaacctctgtacccaataaacagtaactcactccttctccccataacccttagcacacaccattctacattctgtctctatgtaactggctattctaactatcttttataaatggaattatatgataattatccttttgtgtctggtttatttcagttagcataatatcttcaaggttcatccattttgcatgatgtattggaattttattccttgttaaggttgaataacatttcaatgtatagatacacctcatttgcctacccacttatctttcaatggacttttcagttgtttccattttttcgctagtgtgagtaatgcttctctgaacatcagtgtacaaatatttgttcaaatttctttcaattctatggggagtatgtccagaagtggaattgctggatcaaatggtaatttattgtttaattttttgagaaacagccacaccactttttacagtggctataacatttcccattcccatcagcaatgcactagagctccaatttttccatctacttgaaaacacctgttgttttgtgttgttgtcattgttgttgtttatcaaagccatcctaaattgtgtgaggtggtgtagcattgtggttttgatttgcatatctctaagtattcgtgatgctgaggaactttgcatgggcttattggatatttgtatatcttccttggagaaaactccattttaatcctttgttcattttttaattgggtttttggatgtttgctgttgttgacttgtagcttttcatgtattctggaaattaatttcttatcacacatataatttgcaaatatttttatc

SEQ ID NO: 732671 - DNA, 2501 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctggtaagtggatcccagcatccttggcagtagggttttatgtggagtctatctggctttcagagaagagtcaggaaaacatttttattcccagcctgtgtcccatgggcacaagcaaatcccaaattctcctcctgaaccctcccaatttgtctctacagactctcttctccttgtttttctgttttcttatggctgaccttgtgtctggcctgaaaaaggtagggagggggctttatcagccctgagccctatgtggtagaagaggcttcagagagggacaagaaggagagtcctcaagatcaagttgcttctcgctgtcaccgacacatccccttctgccacgtcttttttttcttgtacctattccatgagctacaaggaacagctgaggctttgaaacaagctcacacttttcccccagatgagaggaggaagccccttgggtgagggaggagcagctcagactctgcttcctgctctgctccgggctcctctggtgactggccctgcctcactcaacctggggtgggactagcgtgtgtgtagaaagggccctggtggcctgtcctgaatttggctaaattgagctgccagttgaagccaagcctcccccgggccaggctgcagggaaataagaagagagggagcctcagggcagactcctgagctgcgtcctggctctgaagtcaccagctgtatgaggctttgggcacagcacgtgggacacagcacggaggacagtgactgatgcagagctggaggaatagggagattcaccgttggggttattcatggcaggaaaggggcagtgccaaaaagtgtgtaattatagagagggtaagactaccagacactttatatatatctaatataagacttaccattaactatttctatgtgtgcaatttagtgttgtgtaaccatcacactatccatttccagaactttttcctcttaccatattaaacctctgtacccaataaacagtaactctcactccttcttcccctaacccttagcacccatcattctactttgtctctatgtaactggctattctaactatcttttataaatggaattacaaaaaaacaaaaaaaaaaaaaaaaaaaaaaaattgtgtggggcgcgcgcctgtgggcccctgagagaaaggttttttgagagaaacaattgggtgtgtgggggcgggggaccccaagatagaggtaaacggcaaacgtgggcacaaaaggggtgttccatgagagaaaccggggacacgacacaagggcggggaatccacacagaaatagaaaagcggcccgcggggaaacgacgaagcgttctgggaaaaacatcccaagaaggagaatcgagagaggacatcggagggaaacaaacaaaggagagtccaagggagaccgaatacacattaagcccggcgcgggagat

SEQ ID NO: 732672 - DNA, 1877 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctggacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaacaaaaaaaaaaaaaaaaaaaaaaaattgtgtggggcgcgcgcctgtgggcccctgagagaaaggttttttgagagaaacaattgggtgtgtgggggcgggggaccccaagatagaggtaaacggcaaacgtgggcacaaaaggggtgttccatgagagaaaccggggacacgacacaagggcggggaatccacacagaaatagaaaagcggcccgcggggaaacgacgaagcgttctgggaaaaacatcccaagaaggagaatcgagagaggacatcggagggaaacaaacaaaggagagtccaagggagaccgaatacacattaagcccggcgcgggagat

SEQ ID NO: 732673 - DNA, 1892 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaacaaaaaaaaaaaaaaaaaaaaaaaattgtgtggggcgcgcgcctgtgggcccctgagagaaaggttttttgagagaaacaattgggtgtgtgggggcgggggaccccaagatagaggtaaacggcaaacgtgggcacaaaaggggtgttccatgagagaaaccggggacacgacacaagggcggggaatccacacagaaatagaaaagcggcccgcggggaaacgacgaagcgttctgggaaaaacatcccaagaaggagaatcgagagaggacatcggagggaaacaaacaaaggagagtccaagggagaccgaatacacattaagcccggcgcgggagat

SEQ ID NO: 732674 - DNA, 1960 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaacaaaaaaaaaaaaaaaaaaaaaaaattgtgtggggcgcgcgcctgtgggcccctgagagaaaggttttttgagagaaacaattgggtgtgtgggggcgggggaccccaagatagaggtaaacggcaaacgtgggcacaaaaggggtgttccatgagagaaaccggggacacgacacaagggcggggaatccacacagaaatagaaaagcggcccgcggggaaacgacgaagcgttctgggaaaaacatcccaagaaggagaatcgagagaggacatcggagggaaacaaacaaaggagagtccaagggagaccgaatacacattaagcccggcgcgggagat

SEQ ID NO: 732675 - DNA, 2206 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgtttgtccagaagtggaattgctggatcaaatgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaagttaatgaacaggctgataccttcatgaaattcaagacaaagaagaaaaaaactcaatgttattggactaaataatcaaaaggataatgttttcataattttttattggaaaatgtgctgattccttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaagaatctgctctctttataacaggacacatttgaaaacattggttatattaccaaggctttgactgggatgttatatttgagaatatacatagaataaacccatagggaatgcaggcaaagtctgaagtgggccttggtttggcttcctagtctcaagaggtttttggaagtttcatctgagattcttattaaaaacttctagcaaagagaagtttaaaaagagcctctatggtccattgctactcttgccgcacttaggtaaaaaatctgggcaagttcggtgagactcaacctattttgcaagcaaattcatcttattggaattatctttggtaaaaatagagactccgatagagagaaaaactagctgaaaagaaaaactgtagtacacctgttaccagattgaaccactgttcattatctttgagtatttataatccactggtagactggactggaccctgaattcttttagttcttccaattcagttttctccaatgaaatcattaagaacaagagcggctctgttcctgaagccatataaggtggaggtggaca

SEQ ID NO: 732676 - DNA, 1278 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgtgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttc

SEQ ID NO: 732677 - DNA, 1157 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttccaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaataaacaaaaaaaaaaaaaaaaaaaaaaaaaaaaagaaaaaaaaaaaaaaaaaaaaaaaaaaaaaaa

SEQ ID NO: 732678 - DNA, 1128 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttccaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaaaaaagaaaaaaaaaaaaaaaaaaaaaaaaaaaaaaa

SEQ ID NO: 732679 - DNA, 1706 bp, Homo sapiens
actgactacttgtgggagagaaggaaaaaaagctaagtgcaaagaatcaagcctgatatgttagtttttaccaactgagatgcacccaagatgggattagacatacaagataatttatcagggaggacacctgtgagggaatgtggggcagacatgaaggcagtatgggagaacccacagaccactatgcagagctgattcctgtgaaaaagaaagagaaagaagttttaggtaccaatgcagttctaagagtttttgcaaggctgagggggagtcctccaaccagtcaccctttagagttaaagagagcctcagagaactaggcttgctttcacgcccttcctgggagcctgtgggaaagaagctttctgtgcaaaggaggtgatgaatgtgaaatgcacggacgtgggccttctgtcaatcagctccctgccatggagacctgacagagtctcattcatggctgccacaacagagagactgagaaaaagatgcaaccatgaaaaggtgaaaaggtggtaagttctaatgacatagaaaatagcaatcagcctttcttatgtctgaaagccttccaaaatatctgagtgcagtagagatttgacagaggactgatcaccatcctagaaacatggtgagagggaaaaaaaaaactgcaagaatataatcatctcccatcaatttcccaagaggaataatgtagtacttgaagaaacaattatagagtacctcatgctacatgcctcttcctgaggctcccccatgtaaaataacatcaccttcattccttctttacttttctttccatgacagctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaacaaaaaaaaaaaaaaaaaaaaaaaattgtgtggggcgcgcgcctgtgggcccctgagagaaaggttttttgagagaaacaattgggtgtgtgggggcgggggaccccaagatagaggtaaacggcaaacgtgggcacaaaaggggtgttccatgagagaaaccggggacacgacacaagggcggggaatccacacagaaatagaaaagcggcccgcggggaaacgacgaagcgttctgggaaaaacatcccaagaaggagaatcgagagaggacatcggagggaaacaaacaaaggagagtccaagggagaccgaatacacattaagcccggcgcgggagat

SEQ ID NO: 732680 - DNA, 1638 bp, Homo sapiens
actgactacttgtgggagagaaggaaaaaaagctaagtgcaaagaatcaagcctgatatgttagtttttaccaactgagatgcacccaagatgggattagacatacaagataatttatcagggaggacacctgtgagggaatgtggggcagacatgaaggcagtatgggagaacccacagaccactatgcagagctgattcctgtgaaaaagaaagagaaagaagttttaggtaccaatgcagttctaagagtttttgcaaggctgagggggagtcctccaaccagtcaccctttagagttaaagagagcctcagagaactaggcttgctttcacgcccttcctgggagcctgtgggaaagaagctttctgtgcaaaggaggtgatgaatgtgaaatgcacggacgtgggccttctgtcaatcagctccctgccatggagacctgacagagtctcattcatggctgccacaacagagagactgagaaaaagatgcaaccatgaaaaggtgaaaaggtggtaagttctaatgacatagaaaatagcaatcagcctttcttatgtctgaaagccttccaaaatatctgagtgcagtagagatttgacagaggactgatcaccatcctagaaacatggtgagagggaaaaaaaaaactgcaagaatataatcatctcccatcaatttcccaagaggaataatgtagtacttgaagaaacaattatagagtacctcatgctacatgcctcttcctgaggctcccccatgtaaaataacatcaccttcattccttctttacttttctttccatgacagctccttcaggaataggacgtcttcctctccttaatccaatatagcagccgtgaagtcatttctgtatttcaggaagactggcaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaacaaaaaaaaaaaaaaaaaaaaaaaattgtgtggggcgcgcgcctgtgggcccctgagagaaaggttttttgagagaaacaattgggtgtgtgggggcgggggaccccaagatagaggtaaacggcaaacgtgggcacaaaaggggtgttccatgagagaaaccggggacacgacacaagggcggggaatccacacagaaatagaaaagcggcccgcggggaaacgacgaagcgttctgggaaaaacatcccaagaaggagaatcgagagaggacatcggagggaaacaaacaaaggagagtccaagggagaccgaatacacattaagcccggcgcgggagat

SEQ ID NO: 732681 - DNA, 1487 bp, Homo sapiens
actgactacttgtgggagagaaggaaaaaaagctaagtgcaaagaatcaagcctgatatgttagtttttaccaactgagatgcacccaagatgggattagacatacaagataatttatcagggaggacacctgtgagggaatgtggggcagacatgaaggcagtatgggagaacccacagaccactatgcagagctgattcctgtgaaaaagaaagagaaagaagttttaggtaccaatgcagttctaagagtttttgcaaggctgagggggagtcctccaaccagtcaccctttagagttaaagagagcctcagagaactaggcttgctttcacgcccttcctgggagcctgtgggaaagaagctttctgtgcaaaggaggtgatgaatgtgaaatgcacggacgtgggccttctgtcaatcagctccctgccatggagacctgacagagtctcattcatggctgccacaacagagagactgagaaaaagatgcaaccatgaaaaggtgaaaaggtggtaagttctaatgacatagaaaatagcaatcagcctttcttatgtctgaaagccttccaaaatatctgagtgcagtagagatttgacagaggactgatcaccatcctagaaacatggtgagagggaaaaaaaaaactgcaagaatataatcatctcccatcaatttcccaagaggaataatgtagtacttgaagaaacaattatagagtacctcatgctacatgcctcttcctgaggctcccccatgtaaaataacatcaccttcattccttctttacttttctttccatgacagctccttcaggaataggacgtcttcctctccttaatccaatatagcagccgtgaagtcatttctgtatttcaggaagactggcacaggcaacatctgacctcatggagaacggagactttaggattaacatgtgaacctgagactcagaacacaacctatgtgtggttgagatcttttcctgatgaccagttcatgtgttcaaaaaacatacagaaatgaagaaggcaaggtccctaccccaggagacataaagcctaagacaggaaatgagacctgaaaataatcatgataccaaaatagaaaaaattgaatgccacaagaaatcagagaaatctgatgggaaatagagctacacattggaatcactggaaagcatttttaaaagtggatgctcaagccccacccattagttccagtttaaaggtctggagagggaccaaggcattggtaatttttaagtcttccttgacactactaacatgtaacaaggatggagaactcttgttgtaataggtagaacttaaaactaaatgaatgattttcagctagaagtactggaattacctaaggacctttttcaacatacataagactatacatttttggccctatttatgaatgggctacaccaagaactcagtaatcctcttgagaaacagaagctgaatggaaaa

SEQ ID NO: 732682 - DNA, 2689 bp, Homo sapiens
agcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctggtaagtggatcccagcatccttggcaatagggttttaggtggagtctacctggctttcagagaagagttaggaaaacatttttattcccagcctgtgtcccatgggcacaagcaaatcccaaattctcctcctgaacccttccaatttgtctctacagactctcttctccttgtttttctgttttctcatggctgaccttgtgtctggcctaagaaagttagggagggggctttatcagccctgagccctatgtggtagaggaggcttcacagagggatgagaaggagagtcctcaagatcaagttgcttctcgatgtcaccaacacatccccttctgccatgtctttgtttccttgtacctattccatgagctacaaggaacatctgaggctctgaaacaagctcacacttttcccccaaatgagacgaggaagccccttgggtgagggaggagcagctcagactctgcttcctgctctgctccatgcttctctggtgactgggcctgcctcactcaacctggggtgggaccagcatgtgtggagaaagagtcctggtggcctgtcctgaatttggctaaatcgagctgccagttgaagccaagcctcccccgggccaggctgcagggaaataagaagagagggagcctcagggaagactcctgcgttgcgtcctggctctgaagtcaccggttgtatgaggttgtgggcacagcatgtgggacacagcacggaggatagtgactgatgcagagctggagaaatagagagattcacccctggggctctgcatggcaggaaaggggcagtgccaaaaagtgtgtaattatagagagggtaagactaccagacactttatatatatctaatataagacttaccattaactatttctatgtgtgcaatttagtgttgtgtaaccatcacactatccatttccagaactttttcctcttaccatattaaacctctgtacccaataaacagtaactcactccttctccccataacccttagcacacaccattctacattctgtctctatgtaactggctattctaactatcttttataaatggaattatatgataattatccttttgtgtctggtttatttcagttagcataatatcttcaaggttcatccattttgcatgatgtattggaattttattccttgttaaggttgaataacatttcaatgtatagatacacctcatttgcctacccacttatctttcaatggacttttcagttgtttccattttttcgctagtgtgagtaatgcttctctgaacatcagtgtacaaatatttgttcaaatttctttcaattctatggggagtatgtccagaagtggaattgctggatcaaatggtaatttattgtttaattttttgagaaacagccacaccactttttacagtggctataacatttcccattcccatcagcaatgcactagagctccaatttttccatctacttgaaaacacctgttgttttgtgttgttgtcattgttgttgtttatcaaagccatcctaaattgtgtgaggtggtgtagcattgtggttttgatttgcatatctctaagtattcgtgatgctgaggaactttgcatgggcttattggatatttgtatatcttccttggagaaaactccattttaatcctttgttcattttttaattgggtttttggatgtttgctgttgttgacttgtagcttttcatgtattctggaaattaatttcttatcacacatataatttgcaaatatttttatc

SEQ ID NO: 732683 - DNA, 1741 bp, Homo sapiens
  misc_feature (6)..(6): n is a, c, g, or t
cagcanagaaggaggaaggacagcacagcctacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacctgcccatcactgctcaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaagatgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcacaggcaacatctgacctcatggagaacggagactttaggattaacatgtgaacctgagactcagaacacaacctatgtgtggttgagatcttttcctgatgaccagttcatgtgttcaaaaaacatacagaaatgaagaaggcaaggtccctaccccaggagacataaagcctaagacaggaaatgagacctgaaaataatcatgataccaaaatagaaaaaattgaatgccacaagaaatcagagaaatctgatgggaaatagagctacacattggaatcactggaaagcatttttaaaagtggatgctcaagccccacccattagttccagtttaaaggtctggagagggaccaaggcattggtaatttttaagtcttccttgacactactaacatgtaacaaggatggagaactcttgttgtaataggtagaacttaaaactaaatgaatgattttcagctagaagtactggaattacctaaggacctttttcaacatacataagactatacatttttggccctatttatgaatgggctacaccaagaactcagtaatcctcttgagaaacagaagctgaatggaaaa

SEQ ID NO: 732684 - DNA, 2195 bp, Homo sapiens
gctctaacttggaggcagagacccaagcagctggaggctctgtgtgtgggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732685 - DNA, 2032 bp, Homo sapiens
gctctaacttggaggcagagacccaagcagctggaggctctgtgtgtgggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacattccccgggggccggtattgcttacccggggagggggggtaccgaca

SEQ ID NO: 732686 - DNA, 1374 bp, Homo sapiens
gcgtctagaggatctccatctcaggcaggacgatctcaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732687 - DNA, 1211 bp, Homo sapiens
gcgtctagaggatctccatctcaggcaggacgatctcaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacattccccgggggccggtattgcttacccggggagggggggtaccgaca

SEQ ID NO: 732688 - DNA, 1341 bp, Homo sapiens
gcgtctagaggatctccatctcaggcaggacgatctcaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732689 - DNA, 2162 bp, Homo sapiens
gctctaacttggaggcagagacccaagcagctggaggctctgtgtgtgggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732690 - DNA, 2235 bp, Homo sapiens
gctctaacttggaggcagagacccaagcagctggaggctctgtgtgtgggtcgctgatttcttggagcctgaaaagaaggtaactgggcatatgagggacagatggagtgagtcagtgagagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732691 - DNA, 2202 bp, Homo sapiens
gctctaacttggaggcagagacccaagcagctggaggctctgtgtgtgggtcgctgatttcttggagcctgaaaagaaggtaactgggcatatgagggacagatggagtgagtcagtgagagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732692 - DNA, 2072 bp, Homo sapiens
gctctaacttggaggcagagacccaagcagctggaggctctgtgtgtgggtcgctgatttcttggagcctgaaaagaaggtaactgggcatatgagggacagatggagtgagtcagtgagagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacattccccgggggccggtattgcttacccggggagggggggtaccgaca

SEQ ID NO: 732693 - DNA, 1091 bp, Homo sapiens
gcgtctagaggatctccatctcaggcaggacgatctcaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732694 - DNA, 1124 bp, Homo sapiens
gcgtctagaggatctccatctcaggcaggacgatctcaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732695 - DNA, 2142 bp, Homo sapiens
gctctaacttggaggcagagacccaagcagctggaggctctgtgtgtgggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732696 - DNA, 2109 bp, Homo sapiens
gctctaacttggaggcagagacccaagcagctggaggctctgtgtgtgggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732697 - DNA, 1979 bp, Homo sapiens
gctctaacttggaggcagagacccaagcagctggaggctctgtgtgtgggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacattccccgggggccggtattgcttacccggggagggggggtaccgaca

SEQ ID NO: 732698 - DNA, 1859 bp, Homo sapiens
gctctaacttggaggcagagacccaagcagctggaggctctgtgtgtgggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732699 - DNA, 1892 bp, Homo sapiens
gctctaacttggaggcagagacccaagcagctggaggctctgtgtgtgggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732700 - DNA, 2288 bp, Homo sapiens
gctctaacttggaggcagagacccaagcagctggaggctctgtgtgtgggtgagtttagccacatcccctaggtgttctccagcttgaggatcgcaggcagagaggaccagcccagcagccacaggcctgaccaaggcccaggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732701 - DNA, 2255 bp, Homo sapiens
gctctaacttggaggcagagacccaagcagctggaggctctgtgtgtgggtgagtttagccacatcccctaggtgttctccagcttgaggatcgcaggcagagaggaccagcccagcagccacaggcctgaccaaggcccaggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732702 - DNA, 2125 bp, Homo sapiens
gctctaacttggaggcagagacccaagcagctggaggctctgtgtgtgggtgagtttagccacatcccctaggtgttctccagcttgaggatcgcaggcagagaggaccagcccagcagccacaggcctgaccaaggcccaggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacattccccgggggccggtattgcttacccggggagggggggtaccgaca

SEQ ID NO: 732703 - DNA, 2235 bp, Homo sapiens
gctctaacttggaggcagagacccaagcagctggaggctctgtgtgtgggtgagtttagccacatcccctaggtgttctccagcttgaggatcgcaggcagagaggaccagcccagcagccacaggcctgaccaaggcccaggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732704 - DNA, 2202 bp, Homo sapiens
gctctaacttggaggcagagacccaagcagctggaggctctgtgtgtgggtgagtttagccacatcccctaggtgttctccagcttgaggatcgcaggcagagaggaccagcccagcagccacaggcctgaccaaggcccaggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732705 - DNA, 2072 bp, Homo sapiens
gctctaacttggaggcagagacccaagcagctggaggctctgtgtgtgggtgagtttagccacatcccctaggtgttctccagcttgaggatcgcaggcagagaggaccagcccagcagccacaggcctgaccaaggcccaggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacattccccgggggccggtattgcttacccggggagggggggtaccgaca

SEQ ID NO: 732706 - DNA, 1952 bp, Homo sapiens
gctctaacttggaggcagagacccaagcagctggaggctctgtgtgtgggtgagtttagccacatcccctaggtgttctccagcttgaggatcgcaggcagagaggaccagcccagcagccacaggcctgaccaaggcccaggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732707 - DNA, 1985 bp, Homo sapiens
gctctaacttggaggcagagacccaagcagctggaggctctgtgtgtgggtgagtttagccacatcccctaggtgttctccagcttgaggatcgcaggcagagaggaccagcccagcagccacaggcctgaccaaggcccaggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732708 - DNA, 2182 bp, Homo sapiens
gctctaacttggaggcagagacccaagcagctggaggctctgtgtgtgggtcgctgatttcttggagcctgaaaagaaggtaactgggcatatgagggacagatggagtgagtcagtgagagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732709 - DNA, 2149 bp, Homo sapiens
gctctaacttggaggcagagacccaagcagctggaggctctgtgtgtgggtcgctgatttcttggagcctgaaaagaaggtaactgggcatatgagggacagatggagtgagtcagtgagagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732710 - DNA, 2019 bp, Homo sapiens
gctctaacttggaggcagagacccaagcagctggaggctctgtgtgtgggtcgctgatttcttggagcctgaaaagaaggtaactgggcatatgagggacagatggagtgagtcagtgagagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacattccccgggggccggtattgcttacccggggagggggggtaccgaca

SEQ ID NO: 732711 - DNA, 1899 bp, Homo sapiens
gctctaacttggaggcagagacccaagcagctggaggctctgtgtgtgggtcgctgatttcttggagcctgaaaagaaggtaactgggcatatgagggacagatggagtgagtcagtgagagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732712 - DNA, 1932 bp, Homo sapiens
gctctaacttggaggcagagacccaagcagctggaggctctgtgtgtgggtcgctgatttcttggagcctgaaaagaaggtaactgggcatatgagggacagatggagtgagtcagtgagagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732713 - DNA, 1321 bp, Homo sapiens
gcgtctagaggatctccatctcaggcaggacgatctcaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732714 - DNA, 1288 bp, Homo sapiens
gcgtctagaggatctccatctcaggcaggacgatctcaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732715 - DNA, 1158 bp, Homo sapiens
gcgtctagaggatctccatctcaggcaggacgatctcaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacattccccgggggccggtattgcttacccggggagggggggtaccgaca

SEQ ID NO: 732716 - DNA, 1038 bp, Homo sapiens
gcgtctagaggatctccatctcaggcaggacgatctcaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732717 - DNA, 1071 bp, Homo sapiens
gcgtctagaggatctccatctcaggcaggacgatctcaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732718 - DNA, 1912 bp, Homo sapiens
gctctaacttggaggcagagacccaagcagctggaggctctgtgtgtgggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732719 - DNA, 1945 bp, Homo sapiens
gctctaacttggaggcagagacccaagcagctggaggctctgtgtgtgggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732720 - DNA, 2005 bp, Homo sapiens
gctctaacttggaggcagagacccaagcagctggaggctctgtgtgtgggtgagtttagccacatcccctaggtgttctccagcttgaggatcgcaggcagagaggaccagcccagcagccacaggcctgaccaaggcccaggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732721 - DNA, 2038 bp, Homo sapiens
gctctaacttggaggcagagacccaagcagctggaggctctgtgtgtgggtgagtttagccacatcccctaggtgttctccagcttgaggatcgcaggcagagaggaccagcccagcagccacaggcctgaccaaggcccaggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732722 - DNA, 1952 bp, Homo sapiens
gctctaacttggaggcagagacccaagcagctggaggctctgtgtgtgggtcgctgatttcttggagcctgaaaagaaggtaactgggcatatgagggacagatggagtgagtcagtgagagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 732723 - DNA, 1985 bp, Homo sapiens
gctctaacttggaggcagagacccaagcagctggaggctctgtgtgtgggtcgctgatttcttggagcctgaaaagaaggtaactgggcatatgagggacagatggagtgagtcagtgagagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaatcgttagtgtgttcacat

SEQ ID NO: 732724 - DNA, 954 bp, Homo sapiens; identical to SEQ ID NO: 67406

SEQ ID NO: 732725 - DNA, 773 bp, Homo sapiens
gcctgagaagccaactcagactcagccaacagagattgttgatttgcctcttaagcaagagattcattgcagctcagcatggctcagaccagctcatacttcatgctgatctcctgcctgatgtttctgtctcagagccaaggccaagaggcccagacagagttgccccaggcccggatcagctgcccagaaggcaccaatgcctatcgctcctactgctactactttaatgaagaccgtgagacctgggttgatgcagatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccttaaataataaaaataaacatgtttccacta

SEQ ID NO: 732726 - DNA, 807 bp, Homo sapiens
gaggttttagctgtaatgaagcctcagtgggatccaaagttgtttttcagttactgagtctgtataatccccactctcaagagaaacatttgaaggtgtgggtgtctcagaggaccttcctggtctcagaaattctgagaggaggttttaaggaaggtaataggtgctttgctctccatctctcagaacccccttccctgtgttctcctacagagattgttgatttgcctcttaagcaagagattcattgcagctcagcatggctcagaccagctcatacttcatgctgatctcctgcctgatgtttctgtctcagagccaaggccaagaggcccagacagagttgccccaggcccggatcagctgcccagaaggcaccaatgcctatcgctcctactgctactactttaatgaagaccgtgagacctgggttgatgcagatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcagctggaaaatacatgtctagaactgatccagcaattacaacg

SEQ ID NO: 732727 - DNA, 626 bp, Homo sapiens
gcctgagaagccaactcagactcagccaacagagattgttgatttgcctcttaagcaagagattcattgcagctcagcatggctcagaccagctcatacttcatgctgatctcctgcctgatgtttctgtctcagagccaaggccaagaggcccagacagagttgccccaggcccggatcagctgcccagaaggcaccaatgcctatcgctcctactgctactactttaatgaagaccgtgagacctgggttgatgcagatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcagctggaaaatacatgtctagaactgatccagcaattacaacg

SEQ ID NO: 732728 - DNA, 549 bp, Homo sapiens
  misc_feature (82)..(82): n is a, c, g, or t
  misc_feature (145)..(145): n is a, c, g, or t
  misc_feature (156)..(156): n is a, c, g, or t
aaattttcgggggggccaaaaacctttggggtggtttcttggtgggctttcaaaaccccaaggggccggggagggggtgccnttttggtggggccttcaactgggattaaaggggaggagtggcaactggatggactttcaattntgggattggcntccatggaccccaaaaaggaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccttaaataataaaaataaacatgtttccacta

SEQ ID NO: 732729 - DNA, 457 bp, Homo sapiens
gtgagaggcagagaatccatccacctgtttctgttctctcctgcttagctccagggatggaactgggactgggatagaggaaaggtgaactcctcattaaggaaatgaatgtttggtttttgtcctgagtcctaaagccaggagggtcatactctttcgggtctcccagttgtaactcttctcattgacttataggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccttaaataataaaaataaacatgtttccacta

SEQ ID NO: 732730 - DNA, 1162 bp, Homo sapiens
ggcccttcgcgcgcagtcccttagggggcgcctggaagcccgcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagccccgacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaaggccg

SEQ ID NO: 732731 - DNA, 1993 bp, Homo sapiens
ggcccttcgcgcgcagtcccttagggggcgcctggaagcccgcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagccccgacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttgtatccttctcagtgtttcttcggcctttctagtggagaggtgctctcggggaagtgtaagtgaccgatgggcagctcggcgtcgatgtgactctttggggaacaaaggggagttgccacggaccaatgtggctgtggaaagccggagcaggctgggtactattgtcctgcatgcggcagagaaacccttggtgatgccgagccgcagacgtttggggcatctttttgaagagcagaagcgagttcagagcggaagaggtttttcagtgaatgaagctatttttaagggagtgtgattgctgccccttgctagtccgatctgggactgggcgtcttcggctataagcagattctgccactcctcagacaccagcaagtctctgcaaatcgcgcctccccatgtcagtgcagtcagcctcagaatcatacaccctctgtgaacacaggaggccttagtttacggggacggggaggcgaaaggagatcatacatggaagcagatctgagaatccctacccagcctctggtgctcttaggccttcttccctgttgctcctcgctttcccttccatcgtgtgtaaagtctctttgacctaaatcagattgcaaaccacccccagatgtcagccctgatcactgacgaagatgaagacatgctgagctacatggtcagcctggaggtgaggccaggaagactggggctagagggtttagcgggggagggtaagggaaataattcattcctgtaagcaagagtgagcacctcacccgaaaacctatctaagctttctccaccttgtcctgacaggtggaagaagagaagcatcctgttcatctctgcaagatcatgttgttctttcggagtaacccctacttccagaataaagtgattaccaaggaatatctggtgaacatcacaggatgggtagtggaaggaagatgggtagtggaaggaagatggtgggtggatcattgccaacgggatccagcccccttcccacaaaaactcctgtctctgtagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaaggccg

SEQ ID NO: 732732 - DNA, 600 bp, Homo sapiens
ttccccagggaccacatccagcttttcttccctcccaagagaccagcgaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagagg

SEQ ID NO: 732733 - DNA, 552 bp, Homo sapiens
aagcagtggtatcaacgcagagtggccattacgtccgggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagagg

SEQ ID NO: 732734 - DNA, 882 bp, Homo sapiens
  misc_feature (848)..(848): n is a, c, g, or t
  misc_feature (852)..(853): n is a, c, g, or t
  misc_feature (855)..(855): n is a, c, g, or t
  misc_feature (866)..(866): n is a, c, g, or t
  misc_feature (869)..(870): n is a, c, g, or t
ttccccagggaccacatccagcttttcttccctcccaagagaccagcgaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggcaaaaaaaaaaaaaaaaaaaaaaaaaaaaactttttggggcggcttgggccttgaaaaaggtttttaaaaccttcggttggggccgggggccccagaggggtaggcgaaccgtggccacaaggcgggtcccaaggagaaaccggggccaagacaaagggcgcggggatcccccccatataaaaaacgcccggggggacacggagggtctcgaacaaatcccaagggggtccgagagggcaacaggggnccanncngggggtccagngannccatataatttg

SEQ ID NO: 732735 - DNA, 677 bp, Homo sapiens
  misc_feature (578)..(578): n is a, c, g, or t
aagcagtggtatcaacgcagagtggccattacgtccgggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggaaaccaccacacaaaaaaacaacaanacaaccacaaaaaacaccacaccccccacaacaaaaaaccacagcacaaaaaaacttgtggggcgcgcgccgccccccacaaaaaaatctccaaacccc

SEQ ID NO: 732736 - DNA, 747 bp, Homo sapiens
ttccccagggaccacatccagcttttcttccctcccaagagaccagcgaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagagg

SEQ ID NO: 732737 - DNA, 661 bp, Homo sapiens
ttccccagggaccacatccagcttttcttccctcccaagagaccagcgaaggctcagtataaatagcagccaccgctccctggcaggagggacccgcagctcagctacagcacagatcagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagagg

SEQ ID NO: 732738 - DNA, 928 bp, Homo sapiens
ttccccagggaccacatccagcttttcttccctcccaagagaccagcgaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggcaaaacgctaaacaacaggagaatggacgggtacctttttgggaccgtgcatctggcccctggaaaagggttttcaaagaccgatcgttgtggggaccgggggctcccctcaggaggcagagcaaacaggtgcaaagagcaggtatgctgaaggaaaacacaccgtggtattaagcaataggcggtggagacttcctgcccgaatttaaacatccgcccgggggagtaacgcggacgctgtctgacaactatctccgaagggctcctagggggccattaacgggagcctttgcacgcggggccccggcgggtcgcgtttaagataccg

SEQ ID NO: 732739 - DNA, 866 bp, Homo sapiens
  misc_feature (632)..(632): n is a, c, g, or t
  misc_feature (639)..(639): n is a, c, g, or t
  misc_feature (643)..(643): n is a, c, g, or t
  misc_feature (649)..(649): n is a, c, g, or t
ttccccagggaccacatccagcttttcttccctcccaagagaccagcgaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaattagtgaggtctatgtccagagaagctgagatatggcatataataggcatctaataaatgcttaagaaggtggaaanaccaccnccanccaccncacaacacaacacaccacacacaacaccctcgggccgcccccgccccgttaagaaagccctcttgaccagacaaaccatggatgtggagcacgggccccacggagtggcgcagcgaaagcgtcgcccacgagcgggacaccagggacaacaagccggcggatgaagacacgcgtgggggataatctcacccgtttaaaaagcacccgcggggacacc

SEQ ID NO: 732740 - DNA, 898 bp, Homo sapiens
ttccccagggaccacatccagcttttcttccctcccaagagaccagcgaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggctttaagaataaaaaataatgatcctgctttgtgtttatcccatgttgagttctgtgcggggcagagggaacacacggtaaatgcgttatggggaattataggctacttgagggagtgacagtctggtggtaactcctgccttcctccatcagtgccacgttggcatcctcttatgcagtcaggcttcagggctgatgggttcagaaccgagggcttctggctctgagtgaggtcctgctgcaaggtttcctagatgagccactgagactctaataagatccagtggaaataaccaggctctcgtcggaatataagtcccaagggaagctgtgccagtcttgtgggcgactgcctgacttactcctttcatttcagcaccatgaagcttctcacgggcctggttttctgctccttggtcctgggtgtcagcagccgaagcttcttttcgttccttggcgaggcttttgatggttatgaatctcaggcacaccttggcatcacctgaaatacccatgccttcaactccccagcagagtctgcagaaactggcctggggtgtggcctg

SEQ ID NO: 732741 - DNA, 418 bp, Homo sapiens
ttccccagggaccacatccagcttttcttccctcccaagagaccagcgaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagctcagggcagggatacaaagcggggagagggtacacaatgggtatctaataaatacttaagagg

SEQ ID NO: 732742 - DNA, 748 bp, Homo sapiens
ttccccagggaccacatccagcttttcttccctcccaagagaccagcgaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcaggcgatgccagagagaatatccagagattctttggcctgcctcagccttccgagtagatggtgtcaggcctctgagcccaagctaagccatcatatcccctgtgatctgcacgtatacatccagatggcctgaagtaactgaataatcacaaaaggagtgaaaatggcctgttcctgccttaactgatgacattccaccacaaaagaagtgaaaatggccagtccctgccttaactgatgacattacctcgtgaaattccttctgctggcctgcctgagaaatactgagcttcctcttcactctgctctcaggagatctggctgtgaggccctcagggcagggatacaaagcggggagagggtacacaatgggtatctaataaatacttaagagg

SEQ ID NO: 732743 - DNA, 777 bp, Homo sapiens
ttccccagggaccacatccagcttttcttccctcccaagagaccagcgaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggcaaaaaaaaaaaaaaaaaaaaaaaaaaaaa

SEQ ID NO: 732744 - DNA, 1075 bp, Homo sapiens
ttccccagggaccacatccagcttttcttccctcccaagagaccagcgaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggcaaaacgctaaacaacaggagaatggacgggtacctttttgggaccgtgcatctggcccctggaaaagggttttcaaagaccgatcgttgtggggaccgggggctcccctcaggaggcagagcaaacaggtgcaaagagcaggtatgctgaaggaaaacacaccgtggtattaagcaataggcggtggagacttcctgcccgaatttaaacatccgcccgggggagtaacgcggacgctgtctgacaactatctccgaagggctcctagggggccattaacgggagcctttgcacgcggggccccggcgggtcgcgtttaagataccg

SEQ ID NO: 732745 - DNA, 743 bp, Homo sapiens
gtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcagtacaggctagataacccaccaatttccccactgtcctctgatcccctcgtgacagaacctttcagcataacgcctcacatcccaagtctatacccttactgaagaatgctgctctgagcttctgcccccagaatcattccaacgaccacactgcaaagcctatgacagcatcaaatttcaggacctgcagggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagagg

SEQ ID NO: 732746 - DNA, 819 bp, Homo sapiens
ttccccagggaccacatccagcttttcttccctcccaagagaccagcgaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggaaaaaaaaaaaaacaaaaaaaaaaaaaaaaaaaaaaaaaaaccaaaaaaaaaaaaaaaaaaaaaaaaaaaaa

SEQ ID NO: 732747 - DNA, 672 bp, Homo sapiens
ttccccagggaccacatccagcttttcttccctcccaagagaccagcgaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggaaaaaaaaaaaaacaaaaaaaaaaaaaaaaaaaaaaaaaaaccaaaaaaaaaaaaaaaaaaaaaaaaaaaaa

SEQ ID NO: 732748 - DNA, 665 bp, Homo sapiens
ttccccagggaccacatccagcttttcttccctcccaagagaccagcgaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggtcgctggtcccctagcactgggcatgctccctgcggccctgttcactagctgtcctctgcctggaacagatctgtcacctctcacttcctcttcactctgctctcaggagatctggctgtgaggccctcagggcagggatacaaagcggggagagggtacacaatgggtatctaataaatacttaagaggaaaaaaaaaaaaacaaaaaaaaaaaaaaaaaaaaaaaaaaac

SEQ ID NO: 732749 - DNA, 716 bp, Homo sapiens
ttccccagggaccacatccagcttttcttccctcccaagagaccagcgaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcagtacaggctagataacccaccaatttccccactgtcctctgatcccctcgtgacagaacctttcagcataacgcctcacatcccaagtctatacccttactgaagaatgctgctctgagcttctgcccccagaatcattccaacgaccacactgcaaagcctatgacagcatcaaatttcaggacctgcagggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagagg

SEQ ID NO: 732750 - DNA, 311 bp, Homo sapiens
ttccccagggaccacatccagcttttcttccctcccaagagaccagcgaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatcaaaaaaaaaaaaaaaaaaaaaaaaaaaaa

SEQ ID NO: 732751 - DNA, 1068 bp, Homo sapiens
gtgaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggctttaagaataaaaaataatgatcctgctttgtgtttatcccatgttgagttctgtgcggggcagagggaacacacggtaaatgcgttatggggaattataggctacttgagggagtgacagtctggtggtaactcctgccttcctccatcagtgccacgttggcatcctcttatgcagtcaggcttcagggctgatgggttcagaaccgagggcttctggctctgagtgaggtcctgctgcaaggtttcctagatgagccactgagactctaataagatccagtggaaataaccaggctctcgtcggaatataagtcccaagggaagctgtgccagtcttgtgggcgactgcctgacttactcctttcatttcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagagg

SEQ ID NO: 732752 - DNA, 1098 bp, Homo sapiens
gtgaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggctttaagaataaaaaataatgatcctgctttgtgtttatcccatgttgagttctgtgcggggcagagggaacacacggtaaatgcgttatggggaattataggctacttgagggagtgacagtctggtggtaactcctgccttcctccatcagtgccacgttggcatcctcttatgcagtcaggcttcagggctgatgggttcagaaccgagggcttctggctctgagtgaggtcctgctgcaaggtttcctagatgagccactgagactctaataagatccagtggaaataaccaggctctcgtcggaatataagtcccaagggaagctgtgccagtcttgtgggcgactgcctgacttactcctttcatttcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggcaaaaaaaaaaaaaaaaaaaaaaaaaaaaa

SEQ ID NO: 732753 - DNA, 1396 bp, Homo sapiens
gtgaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggctttaagaataaaaaataatgatcctgctttgtgtttatcccatgttgagttctgtgcggggcagagggaacacacggtaaatgcgttatggggaattataggctacttgagggagtgacagtctggtggtaactcctgccttcctccatcagtgccacgttggcatcctcttatgcagtcaggcttcagggctgatgggttcagaaccgagggcttctggctctgagtgaggtcctgctgcaaggtttcctagatgagccactgagactctaataagatccagtggaaataaccaggctctcgtcggaatataagtcccaagggaagctgtgccagtcttgtgggcgactgcctgacttactcctttcatttcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggcaaaacgctaaacaacaggagaatggacgggtacctttttgggaccgtgcatctggcccctggaaaagggttttcaaagaccgatcgttgtggggaccgggggctcccctcaggaggcagagcaaacaggtgcaaagagcaggtatgctgaaggaaaacacaccgtggtattaagcaataggcggtggagacttcctgcccgaatttaaacatccgcccgggggagtaacgcggacgctgtctgacaactatctccgaagggctcctagggggccattaacgggagcctttgcacgcggggccccggcgggtcgcgtttaagataccg

SEQ ID NO: 732754 - DNA, 1184 bp, Homo sapiens
gtgaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggctttaagaataaaaaataatgatcctgctttgtgtttatcccatgttgagttctgtgcggggcagagggaacacacggtaaatgcgttatggggaattataggctacttgagggagtgacagtctggtggtaactcctgccttcctccatcagtgccacgttggcatcctcttatgcagtcaggcttcagggctgatgggttcagaaccgagggcttctggctctgagtgaggtcctgctgcaaggtttcctagatgagccactgagactctaataagatccagtggaaataaccaggctctcgtcggaatataagtcccaagggaagctgtgccagtcttgtgggcgactgcctgacttactcctttcatttcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcagtacaggctagataacccaccaatttccccactgtcctctgatcccctcgtgacagaacctttcagcataacgcctcacatcccaagtctatacccttactgaagaatgctgctctgagcttctgcccccagaatcattccaacgaccacactgcaaagcctatgacagcatcaaatttcaggacctgcagggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagagg

SEQ ID NO: 732755 - DNA, 1140 bp, Homo sapiens
gtgaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggctttaagaataaaaaataatgatcctgctttgtgtttatcccatgttgagttctgtgcggggcagagggaacacacggtaaatgcgttatggggaattataggctacttgagggagtgacagtctggtggtaactcctgccttcctccatcagtgccacgttggcatcctcttatgcagtcaggcttcagggctgatgggttcagaaccgagggcttctggctctgagtgaggtcctgctgcaaggtttcctagatgagccactgagactctaataagatccagtggaaataaccaggctctcgtcggaatataagtcccaagggaagctgtgccagtcttgtgggcgactgcctgacttactcctttcatttcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggaaaaaaaaaaaaacaaaaaaaaaaaaaaaaaaaaaaaaaaaccaaaaaaaaaaaaaaaaaaaaaaaaaaaaa

SEQ ID NO: 732756 - DNA, 659 bp, Homo sapiens
taatttttaaaatacccaaagaattgagcaaaaaggactttggcaaggcaggttgttggatttaaaaccgttctcccattaatgccaaagccagcagaggtaccaactatagctccacggccagaagataccagcagctctgcctttactgaaatttcagctggagaaaggtccacaggtgaggtttcttccaaggagtaatttctcttatttgactcttttgagatccttttctcacataattgtcaaatttcaattggagagaaactgtgttttctacctcattacggggtcagtgctgaggagagtaggaactcaggaaatgcttcttgattgactttagtctgctgtattgggtgacaaattgaccacagaccaaataacacgttggaatcctcttattctttctagagatctgggctgagaattaagggtttatgcttcttcttaaaacccgtttcaatctttcatgcagttatgattctcatacaaacaaatggaaatggggaattagtctttcaaattcagtcctttggctggcacagtggctcatgcctgtaatcctttgggaggttgaggtaggaagattgcttgaggccaggagttcgagactagcctgggccgaacatacataccaagaccttgtctctaccaaaaaa

SEQ ID NO: 732757 - DNA, 717 bp, Homo sapiens
taatttttaaaatacccaaagaattgagcaaaaaggactttggcaaggcaggttgttggatttaaaaccgttctcccattaatgccaaagccagcagaggtaccaactatagctccacggccagaagataccagcagctctgcctttactgaaatttcagctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaa

SEQ ID NO: 732758 - DNA, 786 bp, Homo sapiens
taatttttaaaatacccaaagaattgagcaaaaaggactttggcaaggcaggttgttggatttaaaaccgttctcccattaatgccaaagccagcagaggtaccaactatagctccacggccagaagataccagcagctctgcctttactgaaatttcagctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaacacacaacacaacaacaacacccaaaacatgtgtcaccaccactgagccctacgaaaccctttcataaa

SEQ ID NO: 732759 - DNA, 736 bp, Homo sapiens
taatttttaaaatacccaaagaattgagcaaaaaggactttggcaaggcaggttgttggatttaaaaccgttctcccattaatgccaaagccagcagaggtaccaactatagctccacggccagaagataccagcagctctgcctttactgaaatttcagctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaattgaatttgttggtggaaa

SEQ ID NO: 732760 - DNA, 717 bp, Homo sapiens
taatttttaaaatacccaaagaattgagcaaaaaggactttggcaaggcaggttgttggatttaaaaccgttctcccattaatgccaaagccagcagaggtaccaactatagctccacggccagaagataccagcagctctgcctttactgaaatttcagctggagaaaggtccacagcacagtgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaa

SEQ ID NO: 732761 - DNA, 750 bp, Homo sapiens
gagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagtttattttcagctgaactgtagagagtgaaggaagaagccttttttcttcactcctacatgacccaggcattgatccaggcaatgaagattcagtgtaaataaccaccactaacaagaccatggcctttggaacctgtgctaagaggcatggatgagctccctcagcatgtggatggagactgaagagaggtctgaaggctcagtgtggtgtctccattctctaagaagtttggaggagaagctggatacagcaaaacagactgagaaggagcagctgttgggaaaggaggaaaactaggaaagcatggtgttccagaatccctgatggagatattgattagtagtatcagattctgcttagcagttgaggagttcacctttggcttaagcaacatggagtcattgactatctcgtgaaggtggttgcaggagaaggtctggagaactaaatggagcagtgataagagagaatgggagatgg

SEQ ID NO: 732762 - DNA, 663 bp, Homo sapiens
taatttttaaaatacccaaagaattgagcaaaaaggactttggcaaggcaggttgttggatttaaaaccgttctcccattaatgccaaagccagcagaggtaccaactatagctccacggccagaagataccagcagctctgcctttactgaaatttcagctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccgacctgggggtgtctgggctgctaaactcatcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaa

SEQ ID NO: 732763 - DNA, 807 bp, Homo sapiens
gagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaa

SEQ ID NO: 732764 - DNA, 967 bp, Homo sapiens; identical to SEQ ID NO: 78141

SEQ ID NO: 732765 - DNA, 1536 bp, Homo sapiens; identical to SEQ ID NO: 78146

SEQ ID NO: 732766 - DNA, 1284 bp, Homo sapiens
ggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacagacctcagtgggaaggtgtttgtatttcctagagaatctgttactgatcatgtaaacttgatcacaccgctggagaagctcctcatcaggtattgctgaattttggatcaatgggacacctttggtgaaaaagggtctgcgacagggttactttgtggaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacctgcatttgtttagtgcttgtcatagtcccatatctttatcttatgtctactacttatctatctactaattggtgtttcattggtaattggtgtttcattatcctgaaaactccaattgccaagtacggggaggaaaacctgtaagtaactagaaagatatatcgcaaagccagagcactcaatgagcacaacagtggcaatacttaaaagctactaacaatcattttaatgacgattcaaaatatgtgtggaattgtaatcacaattctcctatttgtttttccagctacaaatcgatcaaaaaggggtctgaggttgcatcagggagacaactgtaatgatataagtaagcaatagttgagaacctgacagcaagtaataagacaggaagaataaaactagaagaagtcagaatgaaaaccaaaaaagtatgagactgggatcattttgtatgaagacaaacataactttatgtctcaaaaacctcagtaggactgtacaatgcttgattttcataatgttctcttgatgtcatcaaaaaatattatactctgaatattgctcacatga

SEQ ID NO: 732767 - DNA, 715 bp, Homo sapiens
ggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacagacctcagtgggaaggtgtttgtatttcctagagaatctgttactgatcatgtaaacttgatcacaccgctggagaagctcctcatcaggtattgctgaattttggatcaatgggacacctttggtgaaaaagggtctgcgacagggttactttgtggaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacct

SEQ ID NO: 732768 - DNA, 600 bp, Homo sapiens
ggcatgaatatcagacgctagggggacagccactgtgttgtctgctaccctcatcctggtcactgcttctgctataacagccctaggccaggaatatgaacaagccgctgctttggatctcttcctcatcaggtattgctgaattttggatcaatgggacacctttggtgaaaaagggtctgcgacagggttactttgtggaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacct

SEQ ID NO: 732769 - DNA, 1418 bp, Homo sapiens; identical to SEQ ID NO: 78147

SEQ ID NO: 732770 - DNA, 849 bp, Homo sapiens
aagactggtatcaacgcagagtgcccattacggccgggagggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacagacctcagtgggaaggtgtttgtatttcctagagaatctgttactgatcatgtaaacttgatcacaccgctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccggctccagtgcacatctgtgtgagctgggagtcctcatcaggtattgctgaattttggatcaatgggacacctttattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacct

SEQ ID NO: 732771 - DNA, 1477 bp, Homo sapiens; identical to SEQ ID NO: 78144

SEQ ID NO: 732772 - DNA, 908 bp, Homo sapiens
aagactggtatcaacgcagagtgcccattacggccgggagggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacagacctcagtgggaaggtgtttgtatttcctagagaatctgttactgatcatgtaaacttgatcacaccgctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccggctccagtgcacatctgtgtgagctgggagtcctcatcaggtattgctgaattttggatcaatgggacacctttggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacct

SEQ ID NO: 732773 - DNA, 1656 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaactcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 732774 - DNA, 1473 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaactcactctgtcctgcgcaccaagacaaactccaacatggatccaaagacattttttctacccaagatgagctcctagtatataacaagaatcaacaccagacaaaaaatctcaatcaagatcaacagcatggccgaaagaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 732775 - DNA, 953 bp, Homo sapiens
  misc_feature (838)..(838): n is a, c, g, or t
  misc_feature (840)..(841): n is a, c, g, or t
  misc_feature (846)..(846): n is a, c, g, or t
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtaaactcaattgtctgggccagaaaaatccaatggtccacgaattttttaccagagggcctgtttaagagaacgaaaatttnannaaggnggaggaaatatacactgaaaaagcccggaaggggaggtcccgttaaaaaaaaggcggcggaatggcggggggtgtttttctactatctatcgctccttactccctta

SEQ ID NO: 732776 - DNA, 362 bp, Homo sapiens
  misc_feature (8)..(8): n is a, c, g, or t
cgggtcgnctactactactactaaattcgcggccgcgtcgacacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaaaaaaaagtcgacgcggccgcgaatttagtagtagtagtcgacc

SEQ ID NO: 732777 - DNA, 430 bp, Homo sapiens; identical to SEQ ID NO: 321567
  misc_feature (8)..(8): n is a, c, g, or t

SEQ ID NO: 732778 - DNA, 1862 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaactcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaacaaaacaaaaaaaacaccaacatgtgtgggcgcgcgtcgcaccggaaagagtatacaacttgtgtggggcggcgccaaagaaagaacatgtgagaatggcctgcgacactggggcacaaggtgggtccacacaaacacgcggggacagagttgacacaacgggtggcggcacaaggaacaagagacagcactcaacccggg

SEQ ID NO: 732779 - DNA, 1433 bp, Homo sapiens; identical to SEQ ID NO: 321572

SEQ ID NO: 732780 - DNA, 1639 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggatccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaacaaaacaaaaaaaacaccaacatgtgtgggcgcgcgtcgcaccggaaagagtatacaacttgtgtggggcggcgccaaagaaagaacatgtgagaatggcctgcgacactggggcacaaggtgggtccacacaaacacgcggggacagagttgacacaacgggtggcggcacaaggaacaagagacagcactcaacccggg

SEQ ID NO: 732781 - DNA, 1683 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaactcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaaaaaaaaaaaaaaaaaaaaaaaa

SEQ ID NO: 732782 - DNA, 1624 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaactcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 732783 - DNA, 1460 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggatccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaaaaaaaaaaaaaaaaaaaaaaaa

SEQ ID NO: 732784 - DNA, 1401 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggatccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 732785 - DNA, 1348 bp, Homo sapiens
  misc_feature (8)..(8): n is a, c, g, or t
cgggtcgnctactactactactaaattcgcggccgcgtcgaccccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaactcactctgtcctgcgcaccaagacaaactccaacatggatccaaagacattttttctacccaagatgagctcctagtatataacaagaatcaacaccagacaaaaaatctcaatcaagatcaacagcatggccgaaagaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 732786 - DNA, 1500 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaactcactctgtcctgcgcaccaagacaaactccaacatggatccaaagacattttttctacccaagatgagctcctagtatataacaagaatcaacaccagacaaaaaatctcaatcaagatcaacagcatggccgaaagaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaaaaaaaaaaaaaaaaaaaaaaaa

SEQ ID NO: 732787 - DNA, 1468 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaactcactctgtcctgcgcaccaagacaaactccaacatggatccaaagacattttttctacccaagatgagctcctagtatataacaagaatcaacaccagacaaaaaatctcaatcaagatcaacagcatggccgaaagaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaaaaaaaaaaaaaaaaaaaaaaaa

SEQ ID NO: 732788 - DNA, 1651 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaactcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaaaaaaaaaaaaaaaaaaaaaaaa

SEQ ID NO: 732789 - DNA, 1428 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggatccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaaaaaaaaaaaaaaaaaaaaaaaa

SEQ ID NO: 732790 - DNA, 1375 bp, Homo sapiens
  misc_feature (8)..(8): n is a, c, g, or t
cgggtcgnctactactactactaaattcgcggccgcgtcgaccccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaactcactctgtcctgcgcaccaagacaaactccaacatggatccaaagacattttttctacccaagatgagctcctagtatataacaagaatcaacaccagacaaaaaatctcaatcaagatcaacagcatggccgaaagaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaaaaaaaaaaaaaaaaaaaaaaaa

SEQ ID NO: 732791 - DNA, 1343 bp, Homo sapiens
  misc_feature (8)..(8): n is a, c, g, or t
cgggtcgnctactactactactaaattcgcggccgcgtcgaccccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaactcactctgtcctgcgcaccaagacaaactccaacatggatccaaagacattttttctacccaagatgagctcctagtatataacaagaatcaacaccagacaaaaaatctcaatcaagatcaacagcatggccgaaagaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaaaaaaaaaaaaaaaaaaaaaaaa

SEQ ID NO: 732792 - DNA, 2280 bp, Homo sapiens
gggggcagatcctggggagaatggaggagcacacagaggcaggctcggcaccagagatgggggcccagaaggccctgattgacaatcctgctgacatcctagtcattgctgcatatttcctgctggtcattggcgttggcttgtggtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtgcggcacggaggtgggctgctccaacatcgcctacccgcggctcgtcgtgaagctcatgcccaacggtctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgctgctggtgggacggctctgggtggtgttcatcgtggtagtgtcggtggcctggcttcccgtggtgcaggcggcacagggcgggcagctcttcgattacatccaggcagtctctagctacctggcaccgcccgtgtccgccgtcttcgtgctggcgctcttcgtgccgcgcgttaatgagcagggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacctccaccgcctggtcttcagtctccggcatagcaaggaggaacgggaggacctggatgctgatgagcagcaaggctcctcactccctgtacagaatgggtgcccagagagtgccatggagatgaatgagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgtcctgctgt

SEQ ID NO: 732793 - DNA, 531 bp, Homo sapiens
gtgagacgggctgggccgggaacgggaggggcctggagaagcagccctgctcactccctcctctggccacccaggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacg

SEQ ID NO: 732794 - DNA, 1138 bp, Homo sapiens
aagctctgggactgaggctcctgttggaggggagattgggctttgagctcagggcttcctggaggaggagactgctgagctgatccttgagggacacaaggtttgggtggctttggctcaggtcagtctgaggggtctatgctggggttcatatctagatgatcatagggacaacattgggaaaaacgggccagaagtgatagcctggggagacaaggagggctccagttaagagcccaggagggtgtcagctctgttccttggtgcccagggccccggggccatcacctgcagttgtcctctgggccccagatgtggcccttcccagggccacttgcttggagtagcaccttcacgaagaggtcagatcctcagggatgagggcaaagccaccctcagcggcagtactgccccccgtaggcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccag

SEQ ID NO: 732795 - DNA, 974 bp, Homo sapiens
tgatatgacctgattcagctaaacaaagctggggagcgggaatgagacctgggggacttgtcggctcagtgcccctgagtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccag

SEQ ID NO: 732796 - DNA, 598 bp, Homo sapiens; identical to SEQ ID NO: 280347

SEQ ID NO: 732797 - DNA, 2920 bp, Homo sapiens
  misc_feature (2571)..(2571): n is a, c, g, or t
acagggcagcaggagccttagagcatggacggtgccatggggcctcgggggctgctgttgtgcatgtacctggtatctctcctcatcctgcaggccatgcctgccctgggctcggctacaggcaggtccaagagcagcgagaagcgacaggctgtggacaccgctgtcgatggcgtgttcatccggagtttgaaagtcaactgcaaagtcacctctcgcttcgcccactatgttgtcaccagccaagtggtcaacactgccaatgaagccagggaagtggccttcgacctggaaatccccaagacagcattcatcagtgactttgccgttacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcactcgagacgagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggtgagggccaacctgtcatcccaggccctgcggatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctcngaccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtccaaaaaaaaaa

SEQ ID NO: 732798 - DNA, 2891 bp, Homo sapiens
  misc_feature (2571)..(2571): n is a, c, g, or t
acagggcagcaggagccttagagcatggacggtgccatggggcctcgggggctgctgttgtgcatgtacctggtatctctcctcatcctgcaggccatgcctgccctgggctcggctacaggcaggtccaagagcagcgagaagcgacaggctgtggacaccgctgtcgatggcgtgttcatccggagtttgaaagtcaactgcaaagtcacctctcgcttcgcccactatgttgtcaccagccaagtggtcaacactgccaatgaagccagggaagtggccttcgacctggaaatccccaagacagcattcatcagtgactttgccgttacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcactcgagacgagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggtgagggccaacctgtcatcccaggccctgcggatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctcngaccccacaaagccagatgccacgatggtggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtccaaaaaaaaaa

SEQ ID NO: 732799 - DNA, 2052 bp, Homo sapiens
tgacatttcagctccacccatagcacacccactcaaggaacatataaatgaagagatccgctcagttctcagacaagatttttcaagcaagatgaagtccatcatcctctttgtcctttccctgctccttatcttggagaagcaagcagctgtgatgggacaaaaaggtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgatcatgactggacccgaaaaagtcagcaatatgatttgaatgccctacataaggcgacaaaatcaaaacaacacctaggtggaagtcaacaactgctcaattataaacaagaaggcagagaccatgataaatcaaaaggtcattttcacatgatagttatacatcataaaggaggccaagctcatcatgggacacaaaatccttctcaagatcaggggaatagcccatctggaaagggattatccagtcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcaatcaagatcaagagcatggccggaaggcacataaaatatcatacccgtcttcacgtacagaagaaagacaacttcaccatggagaaaagagtgtacagaaagatgtatccaaaggcagcatttctatccaaactgaagagaaaatacatggcaagtctcaaaaccaggtaacaattcatagtcaagatcaagagcatggccataaggaaaataaaatatcataccaatcttcaagtacagaagaaagacatctcaactgtggagaaaagggcatccagaaaggtgtatccaaaggcagtatttcgatccaaactgaagagcaaatacatggcaagtctcaaaaccaggtaagaattcctagtcaagctcaagagtatggccataaggaaaataaaatatcataccaatcttcgagtacagaagaaagacgtctcaacagtggagaaaaggatgtacagaaaggtgtatccaaaggcagtatttctatccaaactgaagagaaaatacatggcaagtctcaaaaccaggtaacaattcctagtcaagatcaagagcatggccataaggaaaataaaatgtcataccaatcttcaagtacagaagaaagacgactcaactatggaggaaagagcacgcagaaagatgtatcccaaagcagtatttctttccaaattgaaaagctagtagaaggcaagtctcaaatccagacaccaaatcctaatcaagatcaatggtctggccaaaatgcaaaaggaaagtctggtcaatctgcagatagcaaacaagacctactcagtcatgaacaaaaaggcagatacaaacaggaatccagtgagtcacataatattgtaattactgagcatgaggttgcccaagatgatcatttgacacaacaatataatgaagacagaaatccaatatctacatagccctgttgcttagcaaccacttgaaaagctggaccaatagcaaggtgtcacccgacctcagtgaagtctttgatgtttctgagaggcagactcccatgtggtcccagatccttggtccatggatgacaccaccttcccatgcttccttgcattaggctttctaaacccggagccccttcaaacttccaataaagggatcattttctgcttta

SEQ ID NO: 732800 - DNA, 2207 bp, Homo sapiens
  misc_feature (1651)..(1651): n is a, c, g, or t
  misc_feature (1656)..(1656): n is a, c, g, or t
  misc_feature (1659)..(1659): n is a, c, g, or t
gtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcaatcaagatcaagagcatggccggaaggcacataaaatatcatacccgtcttcacgtacagaagaaagacaacttcaccatggagaaaagagtgtacagaaagatgtatccaaaggcagcatttctatccaaactgaagagaaaatacatggcaagtctcaaaaccaggtaacaattcatagtcaagatcaagagcatggccataaggaaaataaaatatcataccaatcttcaagtacagaagaaagacatctcaactgtggagaaaagggcatccagaaaggtgtatccaaaggcagtatttcgatccaaactgaagagcaaatacatggcaagtctcaaaaccaggtaagaattcctagtcaagctcaagagtatggccataaggaaaataaaatatcataccaatcttcgagtacagaagaaagacgtctcaacagtggagaaaaggatgtacagaaaggtgtatccaaaggcagtatttctatccaaactgaagagaaaatacatggcaagtctcaaaaccaggtaacaattcctagtcaagatcaagagcatggccataaggaaaataaaatgtcataccaatcttcaagtacagaagaaagacgactcaactatggaggaaagagcacgcagaaagatgtatcccaaagcagtatttctttccaaattgaaaagctagtagaaggcaagtctcaaatccagacaccaaatcctaatcaagatcaatggtctggccaaaatgcaaaaggaaagtctggtcaatctgcagatagcaaacaagacctactcagtcatgaacaaaaaggcagatacaaacaggaatccagtgagtcacataatattgtaattactgagcatgaggttgcccaagatgatcatttgacacaacaatataatgaagacagaaatccaatatctacatagccctgttgcttagcaaccacttgaaaagctggaccaatagcaaggtgtcacccgacctcagtgaagtctttgatgtttctgagaggcagactcccatgtggtcccagatccttggtccatggatgacaccaccttcccatgcttccttgcattaggctttctaaacccggagccccttcaaacttccaataaagggatcattttctgctttaaaaaaaaaaaacacaacanacacnacnacaaaaacaaaagacacaaacacagtggtggcgggccggccgcgcccagaaaagaaagtttctcctccaacccacttgcttgggggggccgcgggcccccagaggataagcaggaaccagtggctcacagctggccgcccaggagagatcggcggcgcgaacgacagtgggtctggttttcccaccaacaaaaaagccgcggcggggaacaccgaggcgtctggaacacacccgagggggcctgccggcggcgacacacgccgtccaacacaagggggccccagagggcccagtaaaaatcccccccccgacgggtgcgtaaaagagacgaaaagactagaaacacaacaagcacgaaagaagaaaagaccaaacgacaagacagcaaggagaccaacaagagaagagacagaaacagcagaagagaacgaaaaaggaaagacagcagaaacacaaatcgtaacacaacagacgataagacacacatacagcgagaacaacagaacacaaacgatcgcaacagaaagcgacgtcaagcagcccgcgac

SEQ ID NO: 732801 - DNA, 1632 bp, Homo sapiens
gtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcaatcaagatcaagagcatggccggaaggcacataaaatatcatacccgtcttcacgtacagaagaaagacaacttcaccatggagaaaagagtgtacagaaagatgtatccaaaggcagcatttctatccaaactgaagagaaaatacatggcaagtctcaaaaccaggtaacaattcatagtcaagatcaagagcatggccataaggaaaataaaatatcataccaatcttcaagtacagaagaaagacatctcaactgtggagaaaagggcatccagaaaggtgtatccaaaggcagtatttcgatccaaactgaagagcaaatacatggcaagtctcaaaaccaggtaagaattcctagtcaagctcaagagtatggccataaggaaaataaaatatcataccaatcttcgagtacagaagaaagacgtctcaacagtggagaaaaggatgtacagaaaggtgtatccaaaggcagtatttctatccaaactgaagagaaaatacatggcaagtctcaaaaccaggtaacaattcctagtcaagatcaagagcatggccataaggaaaataaaatgtcataccaatcttcaagtacagaagaaagacgactcaactatggaggaaagagcacgcagaaagatgtatcccaaagcagtatttctttccaaattgaaaagctagtagaaggcaagtctcaaatccagacaccaaatcctaatcaagatcaatggtctggccaaaatgcaaaaggaaagtctggtcaatctgcagatagcaaacaagacctactcagtcatgaacaaaaaggcagatacaaacaggaatccagtgagtcacataatattgtaattactgagcatgaggttgcccaagatgatcatttgacacaacaatataatgaagacagaaatccaatatctacatagccctgttgcttagcaaccacttgaaaagctggaccaatagcaaggtgtcacccgacctcagtgaagtctttgatgtttctgagaggcagactcccatgtggtcccagatccttggtccatggatgacaccaccttcccatgcttccttgcattaggctttctaaacccggagccccttcaaacttccaataaagggatcattttctgcttta

SEQ ID NO: 732802 - DNA, 2627 bp, Homo sapiens
  misc_feature (2071)..(2071): n is a, c, g, or t
  misc_feature (2076)..(2076): n is a, c, g, or t
  misc_feature (2079)..(2079): n is a, c, g, or t
tgacatttcagctccacccatagcacacccactcaaggaacatataaatgaagagatccgctcagttctcagacaagatttttcaagcaagatgaagtccatcatcctctttgtcctttccctgctccttatcttggagaagcaagcagctgtgatgggacaaaaaggtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgatcatgactggacccgaaaaagtcagcaatatgatttgaatgccctacataaggcgacaaaatcaaaacaacacctaggtggaagtcaacaactgctcaattataaacaagaaggcagagaccatgataaatcaaaaggtcattttcacatgatagttatacatcataaaggaggccaagctcatcatgggacacaaaatccttctcaagatcaggggaatagcccatctggaaagggattatccagtcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcaatcaagatcaagagcatggccggaaggcacataaaatatcatacccgtcttcacgtacagaagaaagacaacttcaccatggagaaaagagtgtacagaaagatgtatccaaaggcagcatttctatccaaactgaagagaaaatacatggcaagtctcaaaaccaggtaacaattcatagtcaagatcaagagcatggccataaggaaaataaaatatcataccaatcttcaagtacagaagaaagacatctcaactgtggagaaaagggcatccagaaaggtgtatccaaaggcagtatttcgatccaaactgaagagcaaatacatggcaagtctcaaaaccaggtaagaattcctagtcaagctcaagagtatggccataaggaaaataaaatatcataccaatcttcgagtacagaagaaagacgtctcaacagtggagaaaaggatgtacagaaaggtgtatccaaaggcagtatttctatccaaactgaagagaaaatacatggcaagtctcaaaaccaggtaacaattcctagtcaagatcaagagcatggccataaggaaaataaaatgtcataccaatcttcaagtacagaagaaagacgactcaactatggaggaaagagcacgcagaaagatgtatcccaaagcagtatttctttccaaattgaaaagctagtagaaggcaagtctcaaatccagacaccaaatcctaatcaagatcaatggtctggccaaaatgcaaaaggaaagtctggtcaatctgcagatagcaaacaagacctactcagtcatgaacaaaaaggcagatacaaacaggaatccagtgagtcacataatattgtaattactgagcatgaggttgcccaagatgatcatttgacacaacaatataatgaagacagaaatccaatatctacatagccctgttgcttagcaaccacttgaaaagctggaccaatagcaaggtgtcacccgacctcagtgaagtctttgatgtttctgagaggcagactcccatgtggtcccagatccttggtccatggatgacaccaccttcccatgcttccttgcattaggctttctaaacccggagccccttcaaacttccaataaagggatcattttctgctttaaaaaaaaaaaacacaacanacacnacnacaaaaacaaaagacacaaacacagtggtggcgggccggccgcgcccagaaaagaaagtttctcctccaacccacttgcttgggggggccgcgggcccccagaggataagcaggaaccagtggctcacagctggccgcccaggagagatcggcggcgcgaacgacagtgggtctggttttcccaccaacaaaaaagccgcggcggggaacaccgaggcgtctggaacacacccgagggggcctgccggcggcgacacacgccgtccaacacaagggggccccagagggcccagtaaaaatcccccccccgacgggtgcgtaaaagagacgaaaagactagaaacacaacaagcacgaaagaagaaaagaccaaacgacaagacagcaaggagaccaacaagagaagagacagaaacagcagaagagaacgaaaaaggaaagacagcagaaacacaaatcgtaacacaacagacgataagacacacatacagcgagaacaacagaacacaaacgatcgcaacagaaagcgacgtcaagcagcccgcgac

SEQ ID NO: 732803 - DNA, 673 bp, Homo sapiens
aaattgatatggatgagatgggacaagttgggctggtgggcagctgcatgtgccttggagtgctctgttggcctcttcctaagagaacctccccattggagctgggagcctcccccactcatgtgtcctccaccttggggcccctccatccccaggatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgtgagggctgcaagctcacctcctgcctgcctccccacgcaggcccctgtgcccacccatggggagccacacacacagcaccccagccagccagacacacacacacacacacacacacacagcacccaagccggccagacacaaacacacagcaccccagccagccggaacacacacacacacacacacaacaccccagctggccggacacacacacacacagtaccccagctggccggacacacacacacacagcaccctatccagacacatacacacacacagtaccccagccagctggaaacacacacacacacagc

SEQ ID NO: 732804 - DNA, 476 bp, Homo sapiens
aaattgatatggatgagatgggacaagttgggctggtgggcagctgcatgtgccttggagtgctctgttggcctcttcctaagagaacctccccattggagctgggagcctcccccactcatgtgtcctccaccttggggcccctccatccccaggatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctg

SEQ ID NO: 732805 - DNA, 504 bp, Homo sapiens
  misc_feature (44)..(44): n is a, c, g, or t
cgtacccacggaaggttagactcacatcttacaagatggccaangaggcattttccaggacacgatgaggaagttcctggagcaggagtgcaacgtcctccccttgaagctgctcatgccccagtgcaaccaagtgcttgacgactacttccccctggtcatcgactacttccagaaccagattgtgagggctgcaagctcacctcctgcctgcctccccacgcaggcccctgtgcccacccatggggagccacacacacagcaccccagccagccagacacacacacacacacacacacacacagcacccaagccggccagacacaaacacacagcaccccagccagccggaacacacacacacacacacacaacaccccagctggccggacacacacacacacagtaccccagctggccggacacacacacacacagcaccctatccagacacatacacacacacagtaccccagccagctggaaacacacacacacacagc

SEQ ID NO: 732806 - DNA, 3572 bp, Homo sapiens; identical to SEQ ID NO: 322994

SEQ ID NO: 732807 - DNA, 2642 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732808 - DNA, 2032 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732809 - DNA, 1867 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732810 - DNA, 1814 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732811 - DNA, 2744 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732812 - DNA, 2744 bp, Homo sapiens; identical to SEQ ID NO: 323008

SEQ ID NO: 732813 - DNA, 1814 bp, Homo sapiens
ggagctcacagccaagtccacttcttccatctgaggcggggaagccagccctgttcctgaaaccctgcatcacaagcccctgtgggaggcagtggggaggggaggtcctcccccactcagacctgacccacagggaccagtttaatgtgtccttgccccagtgatgacagctggggatctgggggtggggagtcacccaggacccgggcagtcgcctttccccagctcctagggctcccggccttccctgctgaaacagcaagaccagtgggttggcgtgggaggcctgggcttcaaaccacctctgctatcacctggctgtgggtccccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732814 - DNA, 1204 bp, Homo sapiens
ggagctcacagccaagtccacttcttccatctgaggcggggaagccagccctgttcctgaaaccctgcatcacaagcccctgtgggaggcagtggggaggggaggtcctcccccactcagacctgacccacagggaccagtttaatgtgtccttgccccagtgatgacagctggggatctgggggtggggagtcacccaggacccgggcagtcgcctttccccagctcctagggctcccggccttccctgctgaaacagcaagaccagtgggttggcgtgggaggcctgggcttcaaaccacctctgctatcacctggctgtgggtccccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732815 - DNA, 1039 bp, Homo sapiens
ggagctcacagccaagtccacttcttccatctgaggcggggaagccagccctgttcctgaaaccctgcatcacaagcccctgtgggaggcagtggggaggggaggtcctcccccactcagacctgacccacagggaccagtttaatgtgtccttgccccagtgatgacagctggggatctgggggtggggagtcacccaggacccgggcagtcgcctttccccagctcctagggctcccggccttccctgctgaaacagcaagaccagtgggttggcgtgggaggcctgggcttcaaaccacctctgctatcacctggctgtgggtccccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732816 - DNA, 2735 bp, Homo sapiens; identical to SEQ ID NO: 322996

SEQ ID NO: 732817 - DNA, 1805 bp, Homo sapiens
gaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732818 - DNA, 1195 bp, Homo sapiens
gaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732819 - DNA, 1030 bp, Homo sapiens
gaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732820 - DNA, 2215 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggtgagtccaggcccccagttgcggggaggtaagggggcaggtcctgaccatcagggcatgggaggcccttctgctccccaagcaggaagaggcggccactcctgccggctgctccatcctccctctcaccgcacagctggaggctcctgagggcttctggctggccatcaggaaaacaccctttccggaccccgagcactgccccgcccagaaccccagtcactgagtgcccaacccccagcttcccccccaaccccccgccctgccctgtcccaggcctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccagatgcagcctctgtgaacaggtgcctggaggctgggaaatgaccctgagagggcaggacacagcaaccgtgggcttaaggtgaccttgagagcaagcttggcccactttacaattctgttcagagccagcccctaacatggtggtcatttattcatttgttccctcattttaaaaaatgtaaggccaggcatggtggctcacgccggtaatcccagcactttgggaggccgaggcaggcagatcacctgaggtcaggagttcgagactagcctggccaacatggcgaaaccctgtctctactaaaaatattttttaaaaattagctgagcatggtggcaggtgcctgtaatcccagctactcaggacgcttaggcaggagaatcacttgaacctgggaggcgaaggttgcggtgtgccgagatcgtgccactgcactctagcctaggcaacagagcacaactctgtctcaggaaaaaaaaaaaaaaaaaaaagg

SEQ ID NO: 732821 - DNA, 1378 bp, Homo sapiens; identical to SEQ ID NO: 323000

SEQ ID NO: 732822 - DNA, 3744 bp, Homo sapiens; identical to SEQ ID NO: 322995

SEQ ID NO: 732823 - DNA, 2814 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732824 - DNA, 2204 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732825 - DNA, 2039 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732826 - DNA, 1986 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732827 - DNA, 2916 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732828 - DNA, 2387 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggtgagtccaggcccccagttgcggggaggtaagggggcaggtcctgaccatcagggcatgggaggcccttctgctccccaagcaggaagaggcggccactcctgccggctgctccatcctccctctcaccgcacagctggaggctcctgagggcttctggctggccatcaggaaaacaccctttccggaccccgagcactgccccgcccagaaccccagtcactgagtgcccaacccccagcttcccccccaaccccccgccctgccctgtcccaggcctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccagatgcagcctctgtgaacaggtgcctggaggctgggaaatgaccctgagagggcaggacacagcaaccgtgggcttaaggtgaccttgagagcaagcttggcccactttacaattctgttcagagccagcccctaacatggtggtcatttattcatttgttccctcattttaaaaaatgtaaggccaggcatggtggctcacgccggtaatcccagcactttgggaggccgaggcaggcagatcacctgaggtcaggagttcgagactagcctggccaacatggcgaaaccctgtctctactaaaaatattttttaaaaattagctgagcatggtggcaggtgcctgtaatcccagctactcaggacgcttaggcaggagaatcacttgaacctgggaggcgaaggttgcggtgtgccgagatcgtgccactgcactctagcctaggcaacagagcacaactctgtctcaggaaaaaaaaaaaaaaaaaaaagg

SEQ ID NO: 732829 - DNA, 3788 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732830 - DNA, 2858 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732831 - DNA, 2248 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732832 - DNA, 2083 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732833 - DNA, 3616 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732834 - DNA, 2686 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732835 - DNA, 2076 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732836 - DNA, 1911 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732837 - DNA, 3773 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732838 - DNA, 2843 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732839 - DNA, 2233 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732840 - DNA, 2068 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732841 - DNA, 2015 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732842 - DNA, 2945 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732843 - DNA, 2416 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggtgagtccaggcccccagttgcggggaggtaagggggcaggtcctgaccatcagggcatgggaggcccttctgctccccaagcaggaagaggcggccactcctgccggctgctccatcctccctctcaccgcacagctggaggctcctgagggcttctggctggccatcaggaaaacaccctttccggaccccgagcactgccccgcccagaaccccagtcactgagtgcccaacccccagcttcccccccaaccccccgccctgccctgtcccaggcctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccagatgcagcctctgtgaacaggtgcctggaggctgggaaatgaccctgagagggcaggacacagcaaccgtgggcttaaggtgaccttgagagcaagcttggcccactttacaattctgttcagagccagcccctaacatggtggtcatttattcatttgttccctcattttaaaaaatgtaaggccaggcatggtggctcacgccggtaatcccagcactttgggaggccgaggcaggcagatcacctgaggtcaggagttcgagactagcctggccaacatggcgaaaccctgtctctactaaaaatattttttaaaaattagctgagcatggtggcaggtgcctgtaatcccagctactcaggacgcttaggcaggagaatcacttgaacctgggaggcgaaggttgcggtgtgccgagatcgtgccactgcactctagcctaggcaacagagcacaactctgtctcaggaaaaaaaaaaaaaaaaaaaagg

SEQ ID NO: 732844 - DNA, 3817 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732845 - DNA, 2887 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732846 - DNA, 2277 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732847 - DNA, 2112 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732848 - DNA, 2415 bp, Homo sapiens; identical to SEQ ID NO: 322997

SEQ ID NO: 732849 - DNA, 1485 bp, Homo sapiens
gtctctagagttccctgcagctctctgatgacaactctgctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732850 - DNA, 875 bp, Homo sapiens
gtctctagagttccctgcagctctctgatgacaactctgctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732851 - DNA, 710 bp, Homo sapiens
gtctctagagttccctgcagctctctgatgacaactctgctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732852 - DNA, 3629 bp, Homo sapiens; identical to SEQ ID NO: 323006

SEQ ID NO: 732853 - DNA, 2699 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732854 - DNA, 2089 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732855 - DNA, 1924 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732856 - DNA, 1871 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732857 - DNA, 2801 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732858 - DNA, 2272 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggtgagtccaggcccccagttgcggggaggtaagggggcaggtcctgaccatcagggcatgggaggcccttctgctccccaagcaggaagaggcggccactcctgccggctgctccatcctccctctcaccgcacagctggaggctcctgagggcttctggctggccatcaggaaaacaccctttccggaccccgagcactgccccgcccagaaccccagtcactgagtgcccaacccccagcttcccccccaaccccccgccctgccctgtcccaggcctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccagatgcagcctctgtgaacaggtgcctggaggctgggaaatgaccctgagagggcaggacacagcaaccgtgggcttaaggtgaccttgagagcaagcttggcccactttacaattctgttcagagccagcccctaacatggtggtcatttattcatttgttccctcattttaaaaaatgtaaggccaggcatggtggctcacgccggtaatcccagcactttgggaggccgaggcaggcagatcacctgaggtcaggagttcgagactagcctggccaacatggcgaaaccctgtctctactaaaaatattttttaaaaattagctgagcatggtggcaggtgcctgtaatcccagctactcaggacgcttaggcaggagaatcacttgaacctgggaggcgaaggttgcggtgtgccgagatcgtgccactgcactctagcctaggcaacagagcacaactctgtctcaggaaaaaaaaaaaaaaaaaaaagg

SEQ ID NO: 732859 - DNA, 3673 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732860 - DNA, 2743 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732861 - DNA, 2133 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732862 - DNA, 1968 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732863 - DNA, 416 bp, Homo sapiens
acctgcagtggctattgtccaatggccccgccagcccagggctaccttgcccaaattggggcccaaatgaggaaaggccctgccccctcagcctttcccagatagggttgcgtgggccaccaggggcacaaggcagcaggtgaggttcctgctgaggcaggtggttcacttgagcccaggagttcaagaccagctggccaacatggcgaaaccctgtctctactaaaaatattttttaaaaattagctgagcatggtggcaggtgcctgtaatcccagctactcaggacgcttaggcaggagaatcacttgaacctgggaggcgaaggttgcggtgtgccgagatcgtgccactgcactctagcctaggcaacagagcacaactctgtctcaggaaaaaaaaaaaaaaaaaaaagg

SEQ ID NO: 732864 - DNA, 2120 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732865 - DNA, 3660 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732866 - DNA, 2931 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732867 - DNA, 2730 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732868 - DNA, 1955 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732869 - DNA, 1902 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732870 - DNA, 2832 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732871 - DNA, 2103 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732872 - DNA, 2303 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggtgagtccaggcccccagttgcggggaggtaagggggcaggtcctgaccatcagggcatgggaggcccttctgctccccaagcaggaagaggcggccactcctgccggctgctccatcctccctctcaccgcacagctggaggctcctgagggcttctggctggccatcaggaaaacaccctttccggaccccgagcactgccccgcccagaaccccagtcactgagtgcccaacccccagcttcccccccaaccccccgccctgccctgtcccaggcctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccagatgcagcctctgtgaacaggtgcctggaggctgggaaatgaccctgagagggcaggacacagcaaccgtgggcttaaggtgaccttgagagcaagcttggcccactttacaattctgttcagagccagcccctaacatggtggtcatttattcatttgttccctcattttaaaaaatgtaaggccaggcatggtggctcacgccggtaatcccagcactttgggaggccgaggcaggcagatcacctgaggtcaggagttcgagactagcctggccaacatggcgaaaccctgtctctactaaaaatattttttaaaaattagctgagcatggtggcaggtgcctgtaatcccagctactcaggacgcttaggcaggagaatcacttgaacctgggaggcgaaggttgcggtgtgccgagatcgtgccactgcactctagcctaggcaacagagcacaactctgtctcaggaaaaaaaaaaaaaaaaaaaagg

SEQ ID NO: 732873 - DNA, 3704 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732874 - DNA, 2975 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732875 - DNA, 2774 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732876 - DNA, 2164 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732877 - DNA, 1999 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732878 - DNA, 1279 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagctggctccagtttgttaagggtttcaactgcagccagaggtgttccgtgagggctgatggaggagt

SEQ ID NO: 732879 - DNA, 3015 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732880 - DNA, 2187 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732881 - DNA, 3059 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732882 - DNA, 2843 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732883 - DNA, 2015 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732884 - DNA, 2887 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732885 - DNA, 1308 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagctggctccagtttgttaagggtttcaactgcagccagaggtgttccgtgagggctgatggaggagt

SEQ ID NO: 732886 - DNA, 3044 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732887 - DNA, 2216 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732888 - DNA, 3088 bp, Homo sapiens
agcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagattgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732889 - DNA, 1686 bp, Homo sapiens
gtctctagagttccctgcagctctctgatgacaactctgctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732890 - DNA, 2015 bp, Homo sapiens
ggagctcacagccaagtccacttcttccatctgaggcggggaagccagccctgttcctgaaaccctgcatcacaagcccctgtgggaggcagtggggaggggaggtcctcccccactcagacctgacccacagggaccagtttaatgtgtccttgccccagtgatgacagctggggatctgggggtggggagtcacccaggacccgggcagtcgcctttccccagctcctagggctcccggccttccctgctgaaacagcaagaccagtgggttggcgtgggaggcctgggcttcaaaccacctctgctatcacctggctgtgggtccccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732891 - DNA, 2006 bp, Homo sapiens
gaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732892 - DNA, 2900 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732893 - DNA, 2072 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732894 - DNA, 2944 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732895 - DNA, 2779 bp, Homo sapiens
gaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 732896 - DNA, 1849 bp, Homo sapiens
gaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaa

SEQ ID NO: 732897 - DNA, 1239 bp, Homo sapiens
gaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 732898 - DNA, 1074 bp, Homo sapiens
gaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgta

SEQ ID NO: 732899 - DNA, 2050 bp, Homo sapiens
gaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactc

SEQ ID NO: 732900 - DNA, 348 bp, Homo sapiens; identical to SEQ ID NO: 323001

SEQ ID NO: 732901 - DNA, 1050 bp, Homo sapiens
  misc_feature (1007)..(1007): n is a, c, g, or t
  misc_feature (1010)..(1010): n is a, c, g, or t
  misc_feature (1016)..(1016): n is a, c, g, or t
  misc_feature (1019)..(1019): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732902 - DNA, 220 bp, Homo sapiens; identical to SEQ ID NO: 484722
  misc_feature (1)..(1): n is a, c, g, or t
  misc_feature (28)..(28): n is a, c, g, or t
  misc_feature (33)..(33): n is a, c, g, or t

SEQ ID NO: 732903 - DNA, 390 bp, Homo sapiens; identical to SEQ ID NO: 484723
  misc_feature (1)..(1): n is a, c, g, or t
  misc_feature (28)..(28): n is a, c, g, or t
  misc_feature (33)..(33): n is a, c, g, or t

SEQ ID NO: 732904 - DNA, 275 bp, Homo sapiens; identical to SEQ ID NO: 484727
  misc_feature (1)..(1): n is a, c, g, or t
  misc_feature (28)..(28): n is a, c, g, or t
  misc_feature (33)..(33): n is a, c, g, or t
  misc_feature (256)..(256): n is a, c, g, or t

SEQ ID NO: 732905 - DNA, 311 bp, Homo sapiens; identical to SEQ ID NO: 484725
  misc_feature (1)..(1): n is a, c, g, or t
  misc_feature (28)..(28): n is a, c, g, or t
  misc_feature (33)..(33): n is a, c, g, or t

SEQ ID NO: 732906 - DNA, 1028 bp, Homo sapiens
  misc_feature (985)..(985): n is a, c, g, or t
  misc_feature (988)..(988): n is a, c, g, or t
  misc_feature (994)..(994): n is a, c, g, or t
  misc_feature (997)..(997): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732907 - DNA, 1257 bp, Homo sapiens
  misc_feature (1214)..(1214): n is a, c, g, or t
  misc_feature (1217)..(1217): n is a, c, g, or t
  misc_feature (1223)..(1223): n is a, c, g, or t
  misc_feature (1226)..(1226): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732908 - DNA, 1235 bp, Homo sapiens
  misc_feature (1192)..(1192): n is a, c, g, or t
  misc_feature (1195)..(1195): n is a, c, g, or t
  misc_feature (1201)..(1201): n is a, c, g, or t
  misc_feature (1204)..(1204): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732909 - DNA, 1050 bp, Homo sapiens; identical to SEQ ID NO: 732901
  misc_feature (1007)..(1007): n is a, c, g, or t
  misc_feature (1010)..(1010): n is a, c, g, or t
  misc_feature (1016)..(1016): n is a, c, g, or t
  misc_feature (1019)..(1019): n is a, c, g, or t

SEQ ID NO: 732910 - DNA, 1257 bp, Homo sapiens; identical to SEQ ID NO: 732907
  misc_feature (1214)..(1214): n is a, c, g, or t
  misc_feature (1217)..(1217): n is a, c, g, or t
  misc_feature (1223)..(1223): n is a, c, g, or t
  misc_feature (1226)..(1226): n is a, c, g, or t

SEQ ID NO: 732911 - DNA, 787 bp, Homo sapiens
  misc_feature (744)..(744): n is a, c, g, or t
  misc_feature (747)..(747): n is a, c, g, or t
  misc_feature (753)..(753): n is a, c, g, or t
  misc_feature (756)..(756): n is a, c, g, or t
atcagctcgctaccttaacttagaagttgtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732912 - DNA, 972 bp, Homo sapiens
  misc_feature (929)..(929): n is a, c, g, or t
  misc_feature (932)..(932): n is a, c, g, or t
  misc_feature (938)..(938): n is a, c, g, or t
  misc_feature (941)..(941): n is a, c, g, or t
atcagctcgctaccttaacttagaagttgtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732913 - DNA, 994 bp, Homo sapiens
  misc_feature (951)..(951): n is a, c, g, or t
  misc_feature (954)..(954): n is a, c, g, or t
  misc_feature (960)..(960): n is a, c, g, or t
  misc_feature (963)..(963): n is a, c, g, or t
atcagctcgctaccttaacttagaagttgtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732914 - DNA, 765 bp, Homo sapiens
  misc_feature (722)..(722): n is a, c, g, or t
  misc_feature (725)..(725): n is a, c, g, or t
  misc_feature (731)..(731): n is a, c, g, or t
  misc_feature (734)..(734): n is a, c, g, or t
atcagctcgctaccttaacttagaagttgtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732915 - DNA, 1050 bp, Homo sapiens
  misc_feature (592)..(592): n is a, c, g, or t
  misc_feature (1007)..(1007): n is a, c, g, or t
  misc_feature (1010)..(1010): n is a, c, g, or t
  misc_feature (1016)..(1016): n is a, c, g, or t
  misc_feature (1019)..(1019): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactaganaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732916 - DNA, 1257 bp, Homo sapiens
  misc_feature (592)..(592): n is a, c, g, or t
  misc_feature (1214)..(1214): n is a, c, g, or t
  misc_feature (1217)..(1217): n is a, c, g, or t
  misc_feature (1223)..(1223): n is a, c, g, or t
  misc_feature (1226)..(1226): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactaganaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732917 - DNA, 483 bp, Homo sapiens; identical to SEQ ID NO: 623553

SEQ ID NO: 732918 - DNA, 525 bp, Homo sapiens
  misc_feature (500)..(500): n is a, c, g, or t
  misc_feature (516)..(516): n is a, c, g, or t
atcagctcgctaccttaacttagaagttgtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcacccttttttgggcgaggttgccgttttatntacattttagggacgntttccggtt

SEQ ID NO: 732919 - DNA, 892 bp, Homo sapiens
  misc_feature (849)..(849): n is a, c, g, or t
  misc_feature (852)..(852): n is a, c, g, or t
  misc_feature (858)..(858): n is a, c, g, or t
  misc_feature (861)..(861): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732920 - DNA, 788 bp, Homo sapiens
  misc_feature (763)..(763): n is a, c, g, or t
  misc_feature (779)..(779): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcacccttttttgggcgaggttgccgttttatntacattttagggacgntttccggtt

SEQ ID NO: 732921 - DNA, 948 bp, Homo sapiens
  misc_feature (905)..(905): n is a, c, g, or t
  misc_feature (908)..(908): n is a, c, g, or t
  misc_feature (914)..(914): n is a, c, g, or t
  misc_feature (917)..(917): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacaggccaagcccgcagtgcctacgtctaagctggtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732922 - DNA, 582 bp, Homo sapiens
  misc_feature (539)..(539): n is a, c, g, or t
  misc_feature (542)..(542): n is a, c, g, or t
  misc_feature (548)..(548): n is a, c, g, or t
  misc_feature (551)..(551): n is a, c, g, or t
ggagaggagagcatagcacctgcagcaagatggatgtgggcagcaaagaggtcctgatggagagcccgccgccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732923 - DNA, 977 bp, Homo sapiens
  misc_feature (934)..(934): n is a, c, g, or t
  misc_feature (937)..(937): n is a, c, g, or t
  misc_feature (943)..(943): n is a, c, g, or t
  misc_feature (946)..(946): n is a, c, g, or t
gaaggaggacgtaggagcagcatagcagcgtgcagcgagagatggattgtgtggcatgcaacatagggttccttgactggagacgtacggacgagaccttgcgtccagtgagctacgccggggggcgtattctggcattccctgctgcccggtggcacctggaagcgtcttgcatatacatcgtggatgagtggatggtcgggtaccgcaatcgatctgtgagtcgaatttcgtggagagacgctctgactgcagtaggcgtctactcatcatgatgccaggcccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732924 - DNA, 1184 bp, Homo sapiens
  misc_feature (1141)..(1141): n is a, c, g, or t
  misc_feature (1144)..(1144): n is a, c, g, or t
  misc_feature (1150)..(1150): n is a, c, g, or t
  misc_feature (1153)..(1153): n is a, c, g, or t
gaaggaggacgtaggagcagcatagcagcgtgcagcgagagatggattgtgtggcatgcaacatagggttccttgactggagacgtacggacgagaccttgcgtccagtgagctacgccggggggcgtattctggcattccctgctgcccggtggcacctggaagcgtcttgcatatacatcgtggatgagtggatggtcgggtaccgcaatcgatctgtgagtcgaatttcgtggagagacgctctgactgcagtaggcgtctactcatcatgatgccaggcccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732925 - DNA, 971 bp, Homo sapiens
  misc_feature (928)..(928): n is a, c, g, or t
  misc_feature (931)..(931): n is a, c, g, or t
  misc_feature (937)..(937): n is a, c, g, or t
  misc_feature (940)..(940): n is a, c, g, or t
tgcaagaagcaaatcatatgacctgcggcaaccatgaatgtggtcgagcataggatcgtactgtagtggacataccgcagatggcatgtatctactgacatgattcgccctgggggtcgtatattgaggactttaccatggctgcgcgcaggtgacacctgtgaaatgctgttataattgtggatggtaggtgcgtgagtgcctactatacgtgcgattctagtacttgctagggagtccccatggcttcaatgtgcgtctactcacaatgaacccaccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732926 - DNA, 1156 bp, Homo sapiens
  misc_feature (1113)..(1113): n is a, c, g, or t
  misc_feature (1116)..(1116): n is a, c, g, or t
  misc_feature (1122)..(1122): n is a, c, g, or t
  misc_feature (1125)..(1125): n is a, c, g, or t
tgcaagaagcaaatcatatgacctgcggcaaccatgaatgtggtcgagcataggatcgtactgtagtggacataccgcagatggcatgtatctactgacatgattcgccctgggggtcgtatattgaggactttaccatggctgcgcgcaggtgacacctgtgaaatgctgttataattgtggatggtaggtgcgtgagtgcctactatacgtgcgattctagtacttgctagggagtccccatggcttcaatgtgcgtctactcacaatgaacccaccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732927 - DNA, 1178 bp, Homo sapiens
  misc_feature (1135)..(1135): n is a, c, g, or t
  misc_feature (1138)..(1138): n is a, c, g, or t
  misc_feature (1144)..(1144): n is a, c, g, or t
  misc_feature (1147)..(1147): n is a, c, g, or t
tgcaagaagcaaatcatatgacctgcggcaaccatgaatgtggtcgagcataggatcgtactgtagtggacataccgcagatggcatgtatctactgacatgattcgccctgggggtcgtatattgaggactttaccatggctgcgcgcaggtgacacctgtgaaatgctgttataattgtggatggtaggtgcgtgagtgcctactatacgtgcgattctagtacttgctagggagtccccatggcttcaatgtgcgtctactcacaatgaacccaccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732928 - DNA, 949 bp, Homo sapiens
  misc_feature (906)..(906): n is a, c, g, or t
  misc_feature (909)..(909): n is a, c, g, or t
  misc_feature (915)..(915): n is a, c, g, or t
  misc_feature (918)..(918): n is a, c, g, or t
tgcaagaagcaaatcatatgacctgcggcaaccatgaatgtggtcgagcataggatcgtactgtagtggacataccgcagatggcatgtatctactgacatgattcgccctgggggtcgtatattgaggactttaccatggctgcgcgcaggtgacacctgtgaaatgctgttataattgtggatggtaggtgcgtgagtgcctactatacgtgcgattctagtacttgctagggagtccccatggcttcaatgtgcgtctactcacaatgaacccaccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732929 - DNA, 813 bp, Homo sapiens
  misc_feature (770)..(770): n is a, c, g, or t
  misc_feature (773)..(773): n is a, c, g, or t
  misc_feature (779)..(779): n is a, c, g, or t
  misc_feature (782)..(782): n is a, c, g, or t
tgcaagaagcaaatcatatgacctgcggcaaccatgaatgtggtcgagcataggatcgtactgtagtggacataccgcagatggcatgtatctactgacatgattcgccctgggggtcgtatattgaggactttaccatggctgcgcgcaggtgacacctgtgaaatgctgttataattgtggatggtaggtgcgtgagtgcctactatacgtgcgattctagtacttgctagggagtccccatggcttcaatgtgcgtctactcacaatgaacccaccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732930 - DNA, 971 bp, Homo sapiens; identical to SEQ ID NO: 732925
  misc_feature (928)..(928): n is a, c, g, or t
  misc_feature (931)..(931): n is a, c, g, or t
  misc_feature (937)..(937): n is a, c, g, or t
  misc_feature (940)..(940): n is a, c, g, or t

SEQ ID NO: 732931 - DNA, 1178 bp, Homo sapiens; identical to SEQ ID NO: 732927
  misc_feature (1135)..(1135): n is a, c, g, or t
  misc_feature (1138)..(1138): n is a, c, g, or t
  misc_feature (1144)..(1144): n is a, c, g, or t
  misc_feature (1147)..(1147): n is a, c, g, or t

SEQ ID NO: 732932 - DNA, 971 bp, Homo sapiens
  misc_feature (513)..(513): n is a, c, g, or t
  misc_feature (928)..(928): n is a, c, g, or t
  misc_feature (931)..(931): n is a, c, g, or t
  misc_feature (937)..(937): n is a, c, g, or t
  misc_feature (940)..(940): n is a, c, g, or t
tgcaagaagcaaatcatatgacctgcggcaaccatgaatgtggtcgagcataggatcgtactgtagtggacataccgcagatggcatgtatctactgacatgattcgccctgggggtcgtatattgaggactttaccatggctgcgcgcaggtgacacctgtgaaatgctgttataattgtggatggtaggtgcgtgagtgcctactatacgtgcgattctagtacttgctagggagtccccatggcttcaatgtgcgtctactcacaatgaacccaccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactaganaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732933 - DNA, 709 bp, Homo sapiens
  misc_feature (684)..(684): n is a, c, g, or t
  misc_feature (700)..(700): n is a, c, g, or t
tgcaagaagcaaatcatatgacctgcggcaaccatgaatgtggtcgagcataggatcgtactgtagtggacataccgcagatggcatgtatctactgacatgattcgccctgggggtcgtatattgaggactttaccatggctgcgcgcaggtgacacctgtgaaatgctgttataattgtggatggtaggtgcgtgagtgcctactatacgtgcgattctagtacttgctagggagtccccatggcttcaatgtgcgtctactcacaatgaacccaccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcacccttttttgggcgaggttgccgttttatntacattttagggacgntttccggtt

SEQ ID NO: 732934 - DNA, 533 bp, Homo sapiens
  misc_feature (490)..(490): n is a, c, g, or t
  misc_feature (493)..(493): n is a, c, g, or t
  misc_feature (499)..(499): n is a, c, g, or t
  misc_feature (502)..(502): n is a, c, g, or t
tagctcggcccggttgcaactgaacaccggctctgaggcagcattctcccccagtttttcagccgtaattagtacaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac
